US012122815B2

United States Patent
Imoto et al.

(10) Patent No.: US 12,122,815 B2
(45) Date of Patent: Oct. 22, 2024

(54) GIP RECEPTOR AGONIST PEPTIDE COMPOUNDS AND USES THEREOF

(71) Applicant: TAKEDA PHARMACEUTICAL COMPANY LIMITED, Osaka (JP)

(72) Inventors: Hiroshi Imoto, Fujisawa (JP); Mari Adachi, Fujisawa (JP); Yoko Kanematsu, Fujisawa (JP); Taiji Asami, Fujisawa (JP); Ayumu Niida, Fujisawa (JP); Naoki Nishizawa, Fujisawa (JP); Derek Cecil Cole, San Diego, CA (US); Mack Flinspach, San Diego, CA (US); Nick Scorah, San Diego, CA (US); Abhijit Suresh Bhat, Cambridge, MA (US)

(73) Assignee: TAKEDA PHARMACEUTICAL COMPANY LIMITED, Osaka (JP)

( * ) Notice: Subject to any disclaimer, the term of this patent is extended or adjusted under 35 U.S.C. 154(b) by 0 days.

(21) Appl. No.: 17/279,266

(22) PCT Filed: Sep. 24, 2019

(86) PCT No.: PCT/JP2019/038441
§ 371 (c)(1),
(2) Date: Mar. 24, 2021

(87) PCT Pub. No.: WO2020/067557
PCT Pub. Date: Apr. 2, 2020

(65) Prior Publication Data
US 2022/0135638 A1   May 5, 2022

Related U.S. Application Data

(60) Provisional application No. 62/735,548, filed on Sep. 24, 2018.

(51) Int. Cl.
| | | |
|---|---|---|
| C07K 14/575 | (2006.01) | |
| A61K 9/00 | (2006.01) | |
| A61K 9/08 | (2006.01) | |
| A61K 9/20 | (2006.01) | |
| A61K 38/00 | (2006.01) | |
| A61K 47/02 | (2006.01) | |
| A61P 1/08 | (2006.01) | |

(52) U.S. Cl.
CPC .......... *C07K 14/575* (2013.01); *A61K 9/0019* (2013.01); *A61K 9/08* (2013.01); *A61K 9/2013* (2013.01); *A61K 9/2018* (2013.01); *A61K 9/2059* (2013.01); *A61K 47/02* (2013.01); *A61P 1/08* (2018.01); *A61K 38/00* (2013.01)

(58) Field of Classification Search
None
See application file for complete search history.

(56) References Cited

U.S. PATENT DOCUMENTS

| 10,435,445 B2 * | 10/2019 | Asami ........................ A61P 1/08 |
| 2013/0137631 A1 | 5/2013 | Levy |
| 2017/0240609 A1 * | 8/2017 | Shelton ................ C07K 14/605 |

FOREIGN PATENT DOCUMENTS

| WO | 2013164483 A1 | 11/2013 | |
| WO | 2014192284 A1 | 12/2014 | |
| WO | WO-2018181864 A1 * | 10/2018 | ............. A61K 47/60 |

* cited by examiner

*Primary Examiner* — Christina Bradley
(74) *Attorney, Agent, or Firm* — Honigman LLP

(57) ABSTRACT

The present disclosure provides GIP receptor agonist peptide compounds having an activating action on GIP receptors and use of the GIP receptor agonist peptide as a medicament for the treatment and/or prevention of diabetes, obesity, emesis, or a symptom or condition associated with diabetes, obesity, or emesis. Specifically, a GIP receptor agonist peptide containing a sequence represented by the formula (I) or a salt thereof, and a medicament comprising the same are provided. Formula I: $P^1$-A1-A2-A3-A4-A5-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-$P^2$ (SEQ ID NO: 4), or a salt thereof, wherein each symbol is as defined herein, with the proviso that the GIP receptor agonist peptide does not have an amino acid sequence as provided in SEQ ID NOs: 328-893.

29 Claims, 6 Drawing Sheets

Specification includes a Sequence Listing.

| Compound | LIPIDATION_POSITION | LINKER | LPID | Linker+Lipid | Residues - X | Cap | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 | 38 | 39 | 40 | SEQ ID NO. |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| 507 | 30 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 177 |
| 508 | 30 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 178 |
| 509 | 31 | (PEG3)-gGlu- | Heda | (PEG3)-gGlu-Heda | K-(PEG3)-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 179 |
| 510 | 31 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 180 |
| 511 | 31 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 181 |
| 512 | 32 | (PEG3)-gGlu- | Heda | (PEG3)-gGlu-Heda | K-(PEG3)-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 182 |
| 513 | 32 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 183 |
| 514 | 32 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 184 |
| 515 | 33 | (PEG3)-gGlu- | Heda | (PEG3)-gGlu-Heda | K-(PEG3)-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 185 |
| 516 | 33 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 186 |
| 517 | 33 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 187 |
| 518 | 34 | (PEG3)-gGlu- | Heda | (PEG3)-gGlu-Heda | K-(PEG3)-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 188 |
| 519 | 34 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 189 |
| 520 | 34 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 190 |
| 521 | 35 | (PEG3)-gGlu- | Heda | (PEG3)-gGlu-Heda | K-(PEG3)-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 191 |
| 522 | 35 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 192 |
| 523 | 35 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 193 |
| 524 | 36 | (PEG3)-gGlu- | Heda | (PEG3)-gGlu-Heda | K-(PEG3)-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 194 |
| 525 | 36 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 195 |
| 526 | 36 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 196 |
| 527 | 37 | (PEG3)-gGlu- | Heda | (PEG3)-gGlu-Heda | K-(PEG3)-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 197 |
| 528 | 37 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 198 |
| 529 | 37 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 199 |
| 530 | 38 | (PEG3)-gGlu- | Heda | (PEG3)-gGlu-Heda | K-(PEG3)-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 200 |
| 531 | 38 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 201 |
| 532 | 38 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 202 |
| 533 | 39 | (PEG3)-gGlu- | Heda | (PEG3)-gGlu-Heda | K-(PEG3)-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 203 |
| 534 | 39 | (PEG3)-gGlu- | Oda | (PEG3)-gGlu-Oda | K-(PEG3)-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 204 |
| 535 | 39 | (PEG3)-gGlu- | Eda | (PEG3)-gGlu-Eda | K-(PEG3)-gGlu-Eda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 205 |
| 536 | 30 | Abu-gGlu | Oda | Abu-gGlu-Oda | K-Abu-gGlu-Oda | Me | Y | Aib | E | G | T | F | I | S | D | Y | S | I | A | L | D | R | Aib | H | Q | Aib | N | F | V | N | W | Iva | L | A | Q | X | X | X | X | X | X | X | X | X | 206 |
| 537 | 30 | Abu-gGlu | Heda | Abu-gGlu-Heda | K-Abu-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 207 |
| 538 | 31 | Abu-gGlu | Oda | Abu-gGlu-Oda | K-Abu-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 208 |
| 539 | 32 | Abu-gGlu | Heda | Abu-gGlu-Heda | K-Abu-gGlu-Heda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 209 |
| 540 | 33 | Abu-gGlu | Oda | Abu-gGlu-Oda | K-Abu-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 210 |
| 541 | 34 | Abu-gGlu | Oda | Abu-gGlu-Oda | K-Abu-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 211 |
| 542 | 35 | Abu-gGlu | Oda | Abu-gGlu-Oda | K-Abu-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 212 |
| 543 | 36 | Abu-gGlu | Oda | Abu-gGlu-Oda | K-Abu-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 213 |
| 544 | 37 | Abu-gGlu | Oda | Abu-gGlu-Oda | K-Abu-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 214 |
| 545 | 38 | Abu-gGlu | Oda | Abu-gGlu-Oda | K-Abu-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 215 |
| 546 | 39 | Abu-gGlu | Oda | Abu-gGlu-Oda | K-Abu-gGlu-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 216 |
| 547 | 30 | IgGlu2 | Oda | IgGlu2-Oda | K-IgGlu2-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 217 |
| 548 | 31 | IgGlu2 | Oda | IgGlu2-Oda | K-IgGlu2-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 218 |
| 549 | 32 | IgGlu2 | Oda | IgGlu2-Oda | K-IgGlu2-Oda | Me | Y | Aib | E | G | T | F | I | S | D | Y | S | I | A | L | D | R | Aib | H | Q | Aib | N | F | V | N | W | Iva | L | A | Q | X | X | X | X | X | X | X | X | X | 219 |
| 550 | 34 | IgGlu2 | Oda | IgGlu2-Oda | K-IgGlu2-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 220 |
| 551 | 35 | IgGlu2 | Oda | IgGlu2-Oda | K-IgGlu2-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 221 |
| 552 | 36 | IgGlu2 | Oda | IgGlu2-Oda | K-IgGlu2-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 222 |
| 553 | 37 | IgGlu2 | Oda | IgGlu2-Oda | K-IgGlu2-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 223 |
| 554 | 38 | IgGlu2 | Oda | IgGlu2-Oda | K-IgGlu2-Oda | Me | Y | Aib | E | G | T | F | I | S | D | Y | S | I | A | L | D | R | Aib | H | Q | Aib | N | F | V | N | W | Iva | L | A | Q | R | P | S | G | A | P | P | P | S | 224 |
| 555 | 39 | IgGlu2 | Oda | IgGlu2-Oda | K-IgGlu2-Oda | Me | Y | Aib | E | G | T | F | I | S | D | Y | S | I | A | L | D | R | Aib | H | Q | Aib | N | F | V | N | W | Iva | L | A | Q | X | X | X | X | X | X | X | X | X | 225 |

GIP RECEPTOR AGONIST PEPTIDE COMPOUNDS AND USES THEREOF

CROSS REFERENCE TO RELATED APPLICATIONS

This application claims the benefit of priority from U.S. Provisional Application Ser. No. 62/735,548 filed on Sep. 24, 2018, the entire content of which is incorporated herein by reference in its entirety.

REFERENCE TO THE SEQUENCE LISTING

The instant application contains a Sequence Listing which has been submitted electronically in ST.25 text format, which is hereby incorporated by reference in its entirety. Said Sequence Listing, created on Jan. 27, 2023, is named 223266-486936_SEQ-PRJ_ST25.txt and is 782,521 bytes in size.

TECHNICAL FIELD

The present disclosure relates to a novel peptide compound having an activating action on GIP receptors and use of the peptide compound as a medicament.

BACKGROUND

The statements in this section merely provide background information related to the present disclosure and may not constitute prior art.

Both glucagon-like peptide-1 (GLP-1) and glucose-dependent insulinotropic polypeptide (GIP) are peptides called incretin. GLP-1 and GIP are secreted from small intestinal L cells and K cells, respectively.

GLP-1 acts via GLP-1 receptors and is known to have a glucose-dependent insulinotropic action and a feeding suppressive action. On the other hand, GIP is known to have a glucose-dependent insulinotropic action via GIP receptors, though an influence of GIP only on feeding is not clear.

Attempts have been made to search for peptides having GLP-1 receptor/GIP receptor coagonist or glucagon receptor/GLP-1 receptor/GIP receptor triagonist activity and modifications thereof and develop these peptides as anti-obesity drugs, therapeutic drugs for diabetes, or therapeutic drugs for neurodegenerative disorders on the basis of the structure of natural glucagon, GIP, or GLP-1. However, the peptide compound and the compound having a selective activating action on GIP receptors of the present disclosure for the use in treating emesis and similar symptoms associated with emesis such as nausea and vomiting are not disclosed.

All publications, patents, and patent applications cited herein are incorporated herein by reference in their entirety.

SUMMARY

It is an object of the present invention to provide a GIP receptor agonist peptide compound which has a GIP receptor activation action and is useful as a preventive/therapeutic agent for diabetes, obesity, and/or an antiemetic agent to prevent/treat diseases accompanied by vomiting or nausea.

The present disclosure provides extensive studies to solve the above problem and has found GIP agonist peptide compounds comprising the sequence represented by formulas (I)-(VIII) as compounds having an excellent GIP receptor activation action. Further, the present disclosure provides GIP agonist compounds that selectively activate the GIP receptor and have an antiemetic action and be used to treat and/or prevent emesis in vivo.

The present disclosure provides extensive studies to solve the above problem and found peptide compounds comprising the sequence represented by formulas (I)-(VIII) as novel compounds having an excellent GIP receptor activation action. Further, the present disclosure provides experimental support to show that these GIP agonist peptides selectively activate the GIP receptor and have an antiemetic action.

More specifically, the present disclosure includes the following embodiments: (1) to (19).

(1). A GIP receptor agonist peptide represented by formula (I):

P$^1$-A1-A2-A3-A4-A5-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-P$^2$ (SEQ ID NO: 4), or a salt thereof;

wherein

P$^1$ represents a group represented by formula
—R$^{A1}$,
—CO—R$^{A1}$,
—CO—OR$^{A1}$,
—CO—COR$^{A1}$,
—SO—R$^{A1}$,
—SO$_2$—R$^{A1}$,
—SO$_2$—OR$^{A1}$,
—CO—NR$^{A2}$R$^{A3}$,
—SO$_2$—NR$^{A2}$R$^{A3}$,
—C(=NR$^{A1}$)—NR$^{A2}$R$^{A3}$, or
is absent,
wherein R$^{A1}$, R$^{A2}$, and R$^{A3}$ each independently represent a hydrogen atom, an optionally substituted hydrocarbon group, or an optionally substituted heterocyclic group;

P$^2$ represents —NH$_2$ or —OH;

A1 represents Tyr, 3,5-Dix Tyr, D-Tyr, 3,5 di-Br-Tyr, Phe, αMethyl-Phe, mono-halo-Phe, bis-halo-Phe, -Tyr, -D-Phe, -D-Tyr, des-amino-Phe, or des-amino-Tyr;

A2 represents Aib, Ala, Gly, Sar, Abu, or D-Ala;

A3 represents Glu or Pro;

A4 represents Gly, or Ser;

A5 represents Thr, D-Iva, Glu, Iva, or Ser;

A6 represents Ala, Aib, αMethyl-Phe, A6C, Glu, Iva, Arg, Phe, or Val;

A7 represents Ile, Lys, Val, Ala, Aib, α-methyl-Leu, A6C, Asp, Phe, Gly, Iva, Leu, Arg, or Ser:

A8 represents Ser, Ala, Aib, Asp, Phe, Gly, Leu, or Arg;

A9 represents Asp, Leu, Aib, Glu, Asn, Gln, Ser, or Phe;

A10 represents Aib, αMethyl-Phe, A6C, Lys, or Tyr;

A11 represents Aib Ser, Ala, Glu, Iva, A5c, A6c, or Leu;

A12 represents Ile, Ala, Aib, Glu, αMethyl-Phe, Phe, Lys, Arg, Ser, Trp, A6C, Cys, or Asp;

A13 represents Aib, Ala, Val, Iva, Gln, Leu, Tyr, D-Iva, αMethyl-Phe, A6C, or Glu;

A14 represents Leu, Nle, Tyr, Ala, Aib, αMethyl-Leu, Lys, Leu, Ser, Met, or Me;

A15 represents Ala, Aib, Leu, Asn, Asp, Glu, Lys, Ser, or Tyr;

A16 represents Arg Ala, Aib, Glu, Gly, Leu, Ser, or Lys;

A17 represents Aib, Ala, Lys, Asp, Arg, Gln, Glu, or Ile;

A18 represents Ala, Aib, A6C, Phe, Gly, Iva, Leu, Ser, Trp, or His;

A19 represents Gln, Ala, Val, Aib, Ile, Arg, or Ser;

A20 represents Aib, Ala, Arg, Glu, Gly, Ser, Val, or Gln;

A21 represents Asn, Asp, Glu, Leu, Ala, Aib, Lys, Gln, or Ser;
A22 represents Phe, Glu, Gln, Arg, Trp, or αMePhe;
A23 represents Ile, Aib, Asp, Glu, Arg, Thr or Val;
A24 represents Arg, Asn, Asp, Lys, Lys(Ac), Ala, Aib, Cys, Phe, Leu, Nle, Ser, Asp, or Gln;
A25 represents Trp, Aib, αMethyl-Leu, A6C, Ile, Asn, Nle, Arg, or Val;
A26 represents Aib, Iva, Ala, αMethyl-Leu, A6C, Ile, Asn, Nle, Arg, Val, or Leu;
A27 represents Leu, Val, Ala, Aib, αMethyl-Leu, A6C, Ile, Met, Nle, Arg, Trp, or Ile;
A28 represents Ala, Arg, Lys, Aib, Asp, Asn, or Lys(Ac);
A29 represents Gln, Gly, Arg, Glu, Leu, or Aib;
A30 represents Lys, Arg, Gly, or Glu;
A31 represents Pro, Gly, Hyp, Gln, Phe, ψ, or a deletion;
A32 represents Ser, Gly, Arg, Lys, ψ, or a deletion;
A33 represents Ser, Gly, Pro, Lys, ψ, or a deletion;
A34 represents Gly, Ser, Asn, ψ or a deletion;
A35 represents Ala, Ser, Ser, Asp, ψ, or a deletion;
A36 represents Pro, Gly, Gly, Hyp, Trp, ψ, or a deletion;
A37 represents Pro, Gly, Ala, Hyp, Lys, ψ, or a deletion;
A38 represents Pro, Gly, Hyp, His, ψ, or a deletion;
A39 represents Ser, Gly, Lys, Pro, Asn, ψ, or a deletion;
A40 represents Arg, Ser, Cys, Glu, Lys, Lys-Ac, Pro, Ile, ψ, or a deletion;
A41 represents Gly, Ser, Ile, Thr, ψ, or a deletion;
and wherein any one or two amino acids selected from A31 to A41 optionally represent ψ, wherein ψ is a residue independently selected from Lys, Arg, Orn, and Cys and wherein the side chain of said residue is substituted, with the proviso that the GIP receptor agonist peptide is not a peptide having an amino acid sequence of any one of SEQ ID NOs: 328-893.

(2). The GIP receptor agonist peptide according to (1), represented by formula (II):
$P^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-$P^2$ (SEQ ID NO: 5) or a salt thereof, wherein:
$P^1$ represents a group represented by formula
—$R^{41}$,
—CO—$R^{41}$,
—CO—O$R^{41}$,
—CO—CO$R^{41}$,
—SO—$R^{41}$,
—$SO_2$—$R^{41}$,
—$SO_2$—O$R^{41}$,
—CO—$NR^{42}R^{43}$,
—$SO_2$—$NR^{42}R^{43}$, or
—C(=$NR^{41}$)—$NR^{42}R^{43}$
wherein $R^{41}$, $R^{42}$, and $R^{43}$ each independently represent a hydrogen atom, an optionally substituted hydrocarbon group, or an optionally substituted heterocyclic group;
$P^2$ represents —$NH_2$ or —OH;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;

A15 represents Asp, Glu, Lys, Ser, or Tyr;
A16 represents Arg or Lys;
A17 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, or Gly;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Arg, Ser, ψ, or a deletion;
A41 represents Gly, ψ, or a deletion;
and wherein any one or two amino acids selected from A31 to A41 optionally represent ψ, wherein ψ is a residue independently selected from Lys, Arg, Orn, and Cys, and wherein the side chain of said residue is substituted, with the proviso that the GIP receptor agonist peptide is not a peptide having an amino acid sequence of any one of SEQ ID NOs: 328-893.

(3). The GIP receptor agonist peptide according to (1), represented by formula (III):
$P^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-$P^2$ (SEQ ID NO: 6), or a salt thereof, wherein:
$P^1$ represents a group represented by formula
—$R^{41}$
—CO—$R^{41}$,
—CO—O$R^{41}$,
—CO—CO$R^{41}$,
—SO—$R^{41}$,
—$SO_2$—$R^{41}$,
—$SO_2$—O$R^{41}$,
—CO—$NR^{42}R^{43}$,
—$SO_2$—$NR^{42}R^{43}$, or
—C(=$NR^{41}$)—$NR^{42}R^{43}$
wherein $R^{41}$, $R^{42}$, and $R^{43}$ each independently represent a hydrogen atom, an optionally substituted hydrocarbon group, or an optionally substituted heterocyclic group;
$P^2$ represents —$NH_2$ or —OH;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;

A15 represents Asp, Glu, Lys, Ser, or Tyr;
A16 represents Arg or Lys;
A17 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, or Gly;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Arg, Ser, ψ, or a deletion;
A41 represents Gly, ψ, or a deletion;
and wherein any one or two amino acids selected from A31 to A41 optionally represent ψ, wherein ψ is a residue independently selected from Lys, Arg, Orn, and Cys, and wherein the side chain of said residue is substituted, with the proviso that the GIP receptor agonist peptide is not a peptide having an amino acid sequence of any one of SEQ ID NOs: 328-893.

(4). The GIP receptor agonist peptide according to (1), represented by formula (IV):
P$^1$-A1-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-P$^2$ (SEQ ID NO: 7) or a salt thereof, wherein:
P$^1$ represents a group represented by formula
—R$^{41}$,
—CO—R$^{41}$,
—CO—OR$^{41}$,
—CO—CORAL,
—SO—R$^{41}$
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$
wherein R$^{41}$, R$^{42}$, and R$^{43}$ each independently represent a hydrogen atom, an optionally substituted hydrocarbon group, or an optionally substituted heterocyclic group;
P$^2$ represents —NH$_2$ or —OH;
A1 represents Tyr;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A17 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Arg, Ser, ψ, or a deletion;
A41 represents Gly, ψ, or a deletion;
and wherein any one or two amino acids selected from A31 to A41 optionally represent ψ, wherein ψ is a residue independently selected from Lys, Arg, Orn, and Cys, and wherein the side chain of said residue is substituted, with the proviso that the GIP receptor agonist peptide is not a peptide having an amino acid sequence of any one of SEQ ID NOs: 328-893.

(5). The GIP receptor agonist peptide according to (1) represented by formula (V):
wherein A1-A2-Glu-Gly-Thr-A6-A7-A8-A9-A10-A11-A12-A13-A14-A15-A16-A17-A18-A19-A20-A21-A22-A23-A24-A25-A26-A27-A28-A29 in formula (I) is Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln (SEQ ID NO: 8) or a salt thereof, with the proviso that the GIP receptor agonist peptide is not a peptide having an amino acid sequence of any one of SEQ ID NOs: 328-893.

(6). The GIP receptor agonist peptide according to (1) represented by formula (VI):
P$^1$-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-A30-A31-A32-A33-A34-A35-A36-A37-A38-A39-A40-A41-P$^2$ (SEQ ID NO: 9) or a salt thereof,
wherein
P$^1$ represents a group represented by formula
—R$^{41}$,
—CO—R$^{41}$,
—CO—OR$^{41}$,
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$ wherein $R^{41}$, $R^{42}$, and $R^{43}$ each independently represent a hydrogen atom, an optionally substituted hydrocarbon group, or an optionally substituted heterocyclic group;

$P^2$ represents —NH$_2$ or —OH;
A30 represents Arg;
A31 represents Pro, Gly, or Lys(R);
A32 represents Ser, Gly, or Lys(R);
A33 represents Ser, Gly, or Lys(R);
A34 represents Gly, or Lys(R);
A35 represents Ala, Ser, or Lys(R);
A36 represents Pro, Gly, or Lys(R);
A37 represents Pro, Gly, Lys(R), or a deletion;
A38 represents Pro, Gly, Lys(R), or a deletion;
A39 represents Ser, Gly, Lys(R), or a deletion;
A40 represents Arg, Ser, Lys(R), or a deletion;
A41 represents Gly, Lys(R), or a deletion;
and wherein any one or two amino acids selected from A31 to A41 optionally represent Lys(R), and wherein (R) represents a substituent group, with the proviso that the GIP receptor agonist peptide is not a peptide having an amino acid sequence of any one of SEQ ID NOs: 328-893.

(7). The GIP receptor agonist peptide according to (1), represented by formula (VII):
P$^1$-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-A30-A31-A32-A33-A34-A35-A36-A37-A38-A39-P$^2$ (SEQ ID NO: 10), or a salt thereof, wherein:

$P^1$ represents a group represented by formula
—R$^{41}$,
—CO—R$^{41}$,
—CO—OR$^{41}$,
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$ wherein $R^{41}$, $R^{42}$, and $R^{43}$ each independently represent a hydrogen atom, an optionally substituted hydrocarbon group, or an optionally substituted heterocyclic group;

$P^2$ represents —NH$_2$ or —OH;
A30 represents Arg;
A31 represents Pro, Gly, or Lys(R);
A32 represents Ser, Gly, or Lys(R);
A33 represents Ser, Gly, or Lys(R);
A34 represents Gly, or Lys(R);
A35 represents Ala, Ser, or Lys(R);
A36 represents Pro, Gly, or Lys(R);
A37 represents Pro, Gly, Lys(R);
A38 represents Pro, Gly, Lys(R);
A39 represents Ser, Gly, Lys(R);
and wherein any one or two amino acids selected from A31 to A39 optionally represent Lys(R), and (R) represents a substituent group, or a salt thereof.

(8). The GIP receptor agonist peptide according to (1), represented by formula (VIII):
P$^1$-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-A30-A31-A32-A33-A34-A35-A36-A37-A38-A39-A40-P$^2$ (SEQ ID NO: 11), or a salt thereof, wherein:

$P^1$ represents a group represented by formula
—R$^{41}$,
—CO—R$^{41}$,
—CO—OR$^{41}$,
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$ wherein $R^{41}$, $R^{42}$, and $R^{43}$ each independently represent a hydrogen atom, an optionally substituted hydrocarbon group, or an optionally substituted heterocyclic group;

$P^2$ represents —NH$_2$, and —OH;
A30 represents Arg;
A31 represents Pro, Gly, or Lys(R);
A32 represents Ser, Gly, or Lys(R);
A33 represents Ser, Gly, or Lys(R);
A34 represents Gly, or Lys(R);
A35 represents Ala, Ser, or Lys(R);
A36 represents Pro, or Lys(R);
A37 represents Pro, or Lys(R);
A38 represents Pro, or Lys(R);
A39 represents Ser, or Lys(R);
A40 represents Arg, or Ser;
and wherein any one or two amino acids selected from A31 to A39 optionally represent Lys(R), and (R) represents a substituent group, or a salt thereof.

(9). The GIP receptor agonist peptide according to (1), wherein ψ is a residue independently selected from Lys, Arg, Orn, and Cys, and wherein the side chain of said residue is substituted.

(10). The GIP receptor agonist peptide according to (9), wherein ψ is a residue independently selected from Lys, Arg, Orn, and Cys, and wherein the side chain of said residue is substituted with X-L-. In various embodiments, L represents a bond or a bivalent substituent group, and X represents an optionally substituted hydrocarbon group, or a salt thereof.

(11). The GIP receptor agonist peptide according to (1), wherein the GIP receptor agonist peptide has a selectivity ratio, expressed as a ratio of (GLP1R EC$_{50}$/GIPR EC$_{50}$) of greater than 10, or greater than 100, or greater than 1,000, or greater than 100,000.

(12). The GIP receptor agonist peptide according to (1), wherein the GIP receptor agonist peptide or a medicament comprising the GIP receptor agonist peptide, or a pharmaceutical composition comprising the GIP receptor agonist peptide is administered to treat emesis as a monotherapy.

(13). A medicament comprising the GIP receptor agonist peptide according to (1), or a salt thereof.

(14). Use of the GIP receptor agonist peptide according to (1), or a salt thereof for the manufacture of a suppressant for vomiting or nausea.

(15). The peptide of according to (1), or a salt thereof for use in suppressing vomiting or nausea.

(16). A method for preventing or treating emesis in a subject, comprising administering an effective amount of the peptide of (1), or a salt thereof to the subject.

(17). The medicament according to (13), the use according to (14), the peptide according to (15), the method according to (16), where the emesis, vomiting or the nausea is caused by one or more conditions or causes selected from the following (1) to (10):

(1) Diseases accompanied by vomiting or nausea such as gastroparesis, gastrointestinal hypomotility, peritonitis, abdominal tumor, constipation, gastrointestinal obstruction, chronic intestinal pseudo-obstruction, functional dyspepsia, cyclic vomiting syndrome, chronic unexplained nausea and vomiting, acute pancreatitis, chronic pancreatitis, hepatitis, hyperkalemia, cerebral edema, intracranial lesion, metabolic disorder, gastritis caused by an infection, postoperative disease, myocardial infarction, migraine, intracranial hypertension, and intracranial hypotension (e.g., altitude sickness);

(2) Vomiting and/or nausea induced by chemotherapeutic drugs such as (i) alkylating agents (e.g., cyclophosphamide, carmustine, lomustine, chlorambucil, streptozocin, dacarbazine, ifosfamide, temozolomide, busulfan, bendamustine, and melphalan), cytotoxic antibiotics (e.g., dactinomycin, doxorubicin, mitomycin-C, bleomycin, epirubicin, actinomycin D, amrubicin, idarubicin, daunorubicin, and pirarubicin), antimetabolic agents (e.g., cytarabine, methotrexate, 5-fluorouracil, enocitabine, and clofarabine), vinca alkaloids (e.g., etoposide, vinblastine, and vincristine), other chemotherapeutic agents such as cisplatin, procarbazine, hydroxyurea, azacytidine, irinotecan, interferon α, interleukin-2, oxaliplatin, carboplatin, nedaplatin, and miriplatin; (ii) opioid analgesics (e.g., morphine); (iii) dopamine receptor DID2 agonists (e.g., apomorphine); (iv) cannabis and cannabinoid products including cannabis hyperemesis syndrome;

(3) Vomiting or nausea caused by radiation sickness or radiation therapy for the chest, the abdomen, or the like used to treat cancers;

(4) Vomiting or nausea caused by a poisonous substance or a toxin;

(5) Vomiting and nausea caused by pregnancy including hyperemesis gravidarium; and (6) Vomiting and nausea caused by a vestibular disorder such as motion sickness or dizziness (7) Opioid withdrawal;

(8) Pregnancy including hyperemesis gravidarium;

(9) A vestibular disorder such as motion sickness or dizziness; and

(10) A physical injury causing local, systemic, acute or chronic pain.

(18). The method according to any one of embodiment (16), wherein emesis is treated in a subject not taking a medicament to control a metabolic syndrome disorder.

(19). A GIP receptor agonist peptide of any one of (1)-(8), wherein the peptide selectively activates the GIP receptor and demonstrates an anti-diabetic, anti-obesity and anti-emetic action in vivo.

It should be understood that this disclosure is not limited to the particular methodology, protocols, and reagents, etc., described herein and as such can vary. The terminology used herein is for the purpose of describing particular embodiments only, and is not intended to limit the scope of the present disclosure, which is defined solely by the claims. Other features and advantages of the disclosure will be apparent from the following Detailed Description, the drawings, and the claims.

BRIEF DESCRIPTION OF THE FIGURES

FIGS. 1A-1F are exemplary GIP receptor agonist peptides of the present disclosure which are represented by any one of formulas (I)-(VIII), SEQ ID Nos: 226 to 282. FIG. 1B shows exemplary GIP receptor agonist peptides of the present disclosure which are represented by any one of formulas (I)-(VIII), SEQ ID Nos: 116 to 176. FIG. 1C shows exemplary GIP receptor agonist peptides of the present disclosure which are represented by any one of formulas (I)-(VIII), SEQ ID Nos: 177 to 225. FIG. 1D shows exemplary GIP receptor agonist peptides of the present disclosure which are represented by any one of formulas (I)-(VIII), SEQ ID Nos: 12 to 50. FIG. 1E shows exemplary GIP receptor agonist peptides of the present disclosure which are represented by any one of formulas (I)-(VIII), SEQ ID Nos: 51 to 83. FIG. 1F shows exemplary GIP receptor agonist peptides of the present disclosure which are represented by any one of formulas (I)-(VIII), SEQ ID Nos: 84 to 115.

DETAILED DESCRIPTION OF THE EMBODIMENTS

The definition of each substituent used in the present specification is described in detail in the following. Unless otherwise specified, each substituent has the following definition.

In the present specification, examples of the "halogen atom" include fluorine, chlorine, bromine and iodine.

In the present specification, examples of the "$C_{1-6}$ alkyl group" include methyl, ethyl, propyl, isopropyl, butyl, isobutyl, sec-butyl, tert-butyl, pentyl, isopentyl, neopentyl, 1-ethylpropyl, hexyl, isohexyl, 1,1-dimethylbutyl, 2,2-dimethylbutyl, 3,3-dimethylbutyl and 2-ethylbutyl.

In the present specification, examples of the "optionally halogenated $C_{1-6}$ alkyl group" include a $C_{1-6}$ alkyl group optionally having 1 to 7, preferably 1 to 5, halogen atoms. Specific examples thereof include methyl, chloromethyl, difluoromethyl, trichloromethyl, trifluoromethyl, ethyl, 2-bromoethyl, 2,2,2-trifluoroethyl, tetrafluoroethyl, pentafluoroethyl, propyl, 2,2-difluoropropyl, 3,3,3-trifluoropropyl, isopropyl, butyl, 4,4,4-trifluorobutyl, isobutyl, sec-butyl, tert-butyl, pentyl, isopentyl, neopentyl, 5,5,5-trifluoropentyl, hexyl and 6,6,6-trifluorohexyl.

In the present specification, examples of the "$C_{2-6}$ alkenyl group" include ethenyl, 1-propenyl, 2-propenyl, 2-methyl-1-propenyl, 1-butenyl, 2-butenyl, 3-butenyl, 3-methyl-2-butenyl, 1-pentenyl, 2-pentenyl, 3-pentenyl, 4-pentenyl, 4-methyl-3-pentenyl, 1-hexenyl, 3-hexenyl and 5-hexenyl.

In the present specification, examples of the "$C_{2-6}$ alkynyl group" include ethynyl, 1-propynyl, 2-propynyl, 1-butynyl, 2-butynyl, 3-butynyl, 1-pentynyl, 2-pentynyl, 3-pentynyl, 4-pentynyl, 1-hexynyl, 2-hexynyl, 3-hexynyl, 4-hexynyl, 5-hexynyl and 4-methyl-2-pentynyl.

In the present specification, examples of the "$C_{3-10}$ cycloalkyl group" include cyclopropyl, cyclobutyl, cyclopentyl, cyclohexyl, cycloheptyl, cyclooctyl, bicyclo[2.2.1]heptyl, bicyclo[2.2.2]octyl, bicyclo[3.2.1]octyl and adamantyl.

In the present specification, examples of the "optionally halogenated $C_{3-10}$ cycloalkyl group" include a $C_{3-10}$ cycloalkyl group optionally having 1 to 7, preferably 1 to 5, halogen atoms. Specific examples thereof include cyclopropyl, 2,2-difluorocyclopropyl, 2,3-difluorocyclopropyl, cyclobutyl, difluorocyclobutyl, cyclopentyl, cyclohexyl, cycloheptyl and cyclooctyl.

In the present specification, examples of the "$C_{3-10}$ cycloalkenyl group" include cyclopropenyl, cyclobutenyl, cyclopentenyl, cyclohexenyl, cycloheptenyl and cyclooctenyl.

In the present specification, examples of the "$C_{6-14}$ aryl group" include phenyl, 1-naphthyl, 2-naphthyl, 1-anthryl, 2-anthryl and 9-anthryl.

In the present specification, examples of the "$C_{7-16}$ aralkyl group" include benzyl, phenethyl, naphthylmethyl and phenylpropyl.

In the present specification, examples of the "$C_{1-6}$ alkoxy group" include methoxy, ethoxy, propoxy, isopropoxy, butoxy, isobutoxy, sec-butoxy, tert-butoxy, pentyloxy and hexyloxy.

In the present specification, examples of the "optionally halogenated $C_{1-6}$ alkoxy group" include a $C_{1-6}$ alkoxy group optionally having 1 to 7, preferably 1 to 5, halogen atoms. Specific examples thereof include methoxy, difluoromethoxy, trifluoromethoxy, ethoxy, 2,2,2-trifluoroethoxy, propoxy, isopropoxy, butoxy, 4,4,4-trifluorobutoxy, isobutoxy, sec-butoxy, pentyloxy and hexyloxy.

In the present specification, examples of the "$C_{3-10}$ cycloalkyloxy group" include cyclopropyloxy, cyclobutyloxy, cyclopentyloxy, cyclohexyloxy, cycloheptyloxy and cyclooctyloxy.

In the present specification, examples of the "$C_{1-6}$ alkylthio group" include methylthio, ethylthio, propylthio, isopropylthio, butylthio, sec-butylthio, tert-butylthio, pentylthio and hexylthio.

In the present specification, examples of the "optionally halogenated $C_{1-6}$ alkylthio group" include a $C_{1-6}$ alkylthio group optionally having 1 to 7, preferably 1 to 5, halogen atoms. Specific examples thereof include methylthio, difluoromethylthio, trifluoromethylthio, ethylthio, propylthio, isopropylthio, butylthio, 4,4,4-trifluorobutylthio, pentylthio and hexylthio.

In the present specification, examples of the "$C_{1-6}$ alkyl-carbonyl group" include acetyl, propanoyl, butanoyl, 2-methylpropanoyl, pentanoyl, 3-methylbutanoyl, 2-methylbutanoyl, 2,2-dimethylpropanoyl, hexanoyl and heptanoyl.

In the present specification, examples of the "optionally halogenated $C_{1-6}$ alkyl-carbonyl group" include a $C_{1-6}$ alkyl-carbonyl group optionally having 1 to 7, preferably 1 to 5, halogen atoms. Specific examples thereof include acetyl, chloroacetyl, trifluoroacetyl, trichloroacetyl, propanoyl, butanoyl, pentanoyl and hexanoyl.

In the present specification, examples of the "$C_{1-6}$ alkoxy-carbonyl group" include methoxycarbonyl, ethoxycarbonyl, propoxycarbonyl, isopropoxycarbonyl, butoxycarbonyl, isobutoxycarbonyl, sec-butoxycarbonyl, tert-butoxycarbonyl, pentyloxycarbonyl and hexyloxycarbonyl.

In the present specification, examples of the "$C_{6-14}$ arylcarbonyl group" include benzoyl, 1-naphthoyl and 2-naphthoyl.

In the present specification, examples of the "$C_{7-16}$ aralkyl-carbonyl group" include phenylacetyl and phenylpropionyl.

In the present specification, examples of the "5- to 14-membered aromatic heterocyclylcarbonyl group" include nicotinoyl, isonicotinoyl, thenoyl and furoyl.

In the present specification, examples of the "3- to 14-membered non-aromatic heterocyclylcarbonyl group" include morpholinylcarbonyl, piperidinylcarbonyl and pyrrolidinylcarbonyl.

In the present specification, examples of the "mono- or di-$C_{1-6}$ alkyl-carbamoyl group" include methylcarbamoyl, ethylcarbamoyl, dimethylcarbamoyl, diethylcarbamoyl and N-ethyl-N-methylcarbamoyl.

In the present specification, examples of the "mono- or di-$C_{7-16}$ aralkyl-carbamoyl group" include benzylcarbamoyl and phenethylcarbamoyl.

In the present specification, examples of the "$C_{1-6}$ alkylsulfonyl group" include methylsulfonyl, ethylsulfonyl, propylsulfonyl, isopropylsulfonyl, butylsulfonyl, sec-butylsulfonyl and tert-butylsulfonyl.

In the present specification, examples of the "optionally halogenated $C_{1-6}$ alkylsulfonyl group" include a $C_{1-6}$ alkylsulfonyl group optionally having 1 to 7, preferably 1 to 5, halogen atoms. Specific examples thereof include methylsulfonyl, difluoromethylsulfonyl, trifluoromethylsulfonyl, ethylsulfonyl, propylsulfonyl, isopropylsulfonyl, butylsulfonyl, 4,4,4-trifluorobutylsulfonyl, pentylsulfonyl and hexylsulfonyl.

In the present specification, examples of the "$C_{6-14}$ arylsulfonyl group" include phenylsulfonyl, 1-naphthylsulfonyl and 2-naphthylsulfonyl.

In the present specification, examples of the "substituent" include a halogen atom, a cyano group, a nitro group, an optionally substituted hydrocarbon group, an optionally substituted heterocyclic group, an acyl group, an optionally substituted amino group, an optionally substituted carbamoyl group, an optionally substituted thiocarbamoyl group, an optionally substituted sulfamoyl group, an optionally substituted hydroxy group, an optionally substituted sulfanyl (SH) group and an optionally substituted silyl group.

In the present specification, examples of the "hydrocarbon group" (including "hydrocarbon group" of "optionally substituted hydrocarbon group") include a $C_{1-6}$ alkyl group, a $C_{2-6}$ alkenyl group, a $C_{2-6}$ alkynyl group, a $C_{3-10}$ cycloalkyl group, a $C_{3-10}$ cycloalkenyl group, a $C_{6-14}$ aryl group and a $C_{7-16}$ aralkyl group.

In the present specification, examples of the "optionally substituted hydrocarbon group" include a hydrocarbon group optionally having substituent(s) selected from the following substituent group A.

a halogen atom,
(2) a nitro group,
(3) a cyano group,
(4) an oxo group,
(5) a hydroxy group,
(6) an optionally halogenated $C_{1-6}$ alkoxy group,
(7) a $C_{6-14}$ aryloxy group (e.g., phenoxy, naphthoxy),
(8) a $C_{7-16}$ aralkyloxy group (e.g., benzyloxy),
(9) a 5- to 14-membered aromatic heterocyclyloxy group (e.g., pyridyloxy),
(10) a 3- to 14-membered non-aromatic heterocyclyloxy group (e.g., morpholinyloxy, piperidinyloxy),
(11) a $C_{1-6}$ alkyl-carbonyloxy group (e.g., acetoxy, propanoyloxy),
(12) a $C_{6-14}$ aryl-carbonyloxy group (e.g., benzoyloxy, 1-naphthoyloxy, 2-naphthoyloxy),
(13) a $C_{1-6}$ alkoxy-carbonyloxy group (e.g., methoxycarbonyloxy, ethoxycarbonyloxy, propoxycarbonyloxy, butoxycarbonyloxy),
(14) a mono- or di-$C_{1-6}$ alkyl-carbamoyloxy group (e.g., methylcarbamoyloxy, ethylcarbamoyloxy, dimethylcarbamoyloxy, diethylcarbamoyloxy),
(15) a $C_{6-14}$ aryl-carbamoyloxy group (e.g., phenylcarbamoyloxy, naphthylcarbamoyloxy),
(16) a 5- to 14-membered aromatic heterocyclylcarbonyloxy group (e.g., nicotinoyloxy),
(17) a 3- to 14-membered non-aromatic heterocyclylcarbonyloxy group (e.g., morpholinylcarbonyloxy, piperidinylcarbonyloxy),
(18) an optionally halogenated $C_{1-6}$ alkylsulfonyloxy group (e.g., methylsulfonyloxy, trifluoromethylsulfonyloxy),
(19) a $C_{6-14}$ arylsulfonyloxy group optionally substituted by a $C_{1-6}$ alkyl group (e.g., phenylsulfonyloxy, toluenesulfonyloxy),

(20) an optionally halogenated $C_{1-6}$ alkylthio group,
(21) a 5- to 14-membered aromatic heterocyclic group,
(22) a 3- to 14-membered non-aromatic heterocyclic group,
(23) a formyl group,
(24) a carboxy group,
(25) an optionally halogenated $C_{1-6}$ alkyl-carbonyl group,
(26) a $C_{6-14}$ aryl-carbonyl group,
(27) a 5- to 14-membered aromatic heterocyclylcarbonyl group,
(28) a 3- to 14-membered non-aromatic heterocyclylcarbonyl group,
(29) a $C_{1-6}$ alkoxy-carbonyl group,
(30) a $C_{6-14}$ aryloxy-carbonyl group (e.g., phenyloxycarbonyl, 1-naphthyloxycarbonyl, 2-naphthyloxycarbonyl),
(31) a $C_{7-16}$ aralkyloxy-carbonyl group (e.g., benzyloxycarbonyl, phenethyloxycarbonyl),
(32) a carbamoyl group,
(33) a thiocarbamoyl group,
(34) a mono- or di-$C_{1-6}$ alkyl-carbamoyl group,
(35) a $C_{6-14}$ aryl-carbamoyl group (e.g., phenylcarbamoyl),
(36) a 5- to 14-membered aromatic heterocyclylcarbamoyl group (e.g., pyridylcarbamoyl, thienylcarbamoyl),
(37) a 3- to 14-membered non-aromatic heterocyclylcarbamoyl group (e.g., morpholinylcarbamoyl, piperidinylcarbamoyl),
(38) an optionally halogenated $C_{1-6}$ alkylsulfonyl group,
(39) a $C_{6-14}$ arylsulfonyl group,
(40) a 5- to 14-membered aromatic heterocyclylsulfonyl group (e.g., pyridylsulfonyl, thienylsulfonyl),
(41) an optionally halogenated $C_{1-6}$ alkylsulfinyl group,
(42) a $C_{6-14}$ arylsulfinyl group (e.g., phenylsulfinyl, 1-naphthylsulfinyl, 2-naphthylsulfinyl),
(43) a 5- to 14-membered aromatic heterocyclylsulfinyl group (e.g., pyridylsulfinyl, thienylsulfinyl),
(44) an amino group,
(45) a mono- or di-$C_{1-6}$ alkylamino group (e.g., methylamino, ethylamino, propylamino, isopropylamino, butylamino, dimethylamino, diethylamino, dipropylamino, dibutylamino, N-ethyl-N-methylamino),
(46) a mono- or di-$C_{6-14}$ arylamino group (e.g., phenylamino),
(47) a 5- to 14-membered aromatic heterocyclylamino group (e.g., pyridylamino),
(48) a $C_{7-16}$ aralkylamino group (e.g., benzylamino),
(49) a formylamino group,
(50) a $C_{1-6}$ alkyl-carbonylamino group (e.g., acetylamino, propanoylamino, butanoylamino),
(51) a ($C_{1-6}$ alkyl)($C_{1-6}$ alkyl-carbonyl)amino group (e.g., N-acetyl-N-methylamino),
(52) a $C_{6-14}$ aryl-carbonylamino group (e.g., phenylcarbonylamino, naphthylcarbonylamino),
(53) a $C_{1-6}$ alkoxy-carbonylamino group (e.g., methoxycarbonylamino, ethoxycarbonylamino, propoxycarbonylamino, butoxycarbonylamino, tert-butoxycarbonylamino),
(54) a $C_{7-16}$ aralkyloxy-carbonylamino group (e.g., benzyloxycarbonylamino),
(55) a $C_{1-6}$ alkylsulfonylamino group (e.g., methylsulfonylamino, ethylsulfonylamino),
(56) a $C_{6-14}$ arylsulfonylamino group optionally substituted by a $C_{1-6}$ alkyl group (e.g., phenylsulfonylamino, toluenesulfonylamino),
(57) an optionally halogenated $C_{1-6}$ alkyl group,
(58) a $C_{2-6}$ alkenyl group,
(59) a $C_{2-6}$ alkynyl group,
(60) a $C_{3-10}$ cycloalkyl group,
(61) a $C_{3-10}$ cycloalkenyl group and
(62) a $C_{6-14}$ aryl group.

The number of the above-mentioned substituents in the "optionally substituted hydrocarbon group" is, for example, 1 to 5, preferably 1 to 3. When the number of the substituents is two or more, the respective substituents may be the same or different.

In the present specification, examples of the "heterocyclic group" (including "heterocyclic group" of "optionally substituted heterocyclic group") include (i) an aromatic heterocyclic group, (ii) a non-aromatic heterocyclic group and (iii) a 7- to 10-membered bridged heterocyclic group, each containing, as a ring-constituting atom besides carbon atom, 1 to 4 hetero atoms selected from a nitrogen atom, a sulfur atom and an oxygen atom.

In the present specification, examples of the "aromatic heterocyclic group" (including "5- to 14-membered aromatic heterocyclic group") include a 5- to 14-membered (preferably 5- to 10-membered) aromatic heterocyclic group containing, as a ring-constituting atom besides carbon atom, 1 to 4 hetero atoms selected from a nitrogen atom, a sulfur atom and an oxygen atom.

Preferable examples of the "aromatic heterocyclic group" include 5- or 6-membered monocyclic aromatic heterocyclic groups such as thienyl, furyl, pyrrolyl, imidazolyl, pyrazolyl, thiazolyl, isothiazolyl, oxazolyl, isoxazolyl, pyridyl, pyrazinyl, pyrimidinyl, pyridazinyl, 1,2,4-oxadiazolyl, 1,3,4-oxadiazolyl, 1,2,4-thiadiazolyl, 1,3,4-thiadiazolyl, triazolyl, tetrazolyl, triazinyl and the like; and 8- to 14-membered fused polycyclic (preferably bi or tricyclic) aromatic heterocyclic groups such as benzothiophenyl, benzofuranyl, benzimidazolyl, benzoxazolyl, benzisoxazolyl, benzothiazolyl, benzisothiazolyl, benzotriazolyl, imidazopyridinyl, thienopyridinyl, furopyridinyl, pyrrolopyridinyl, pyrazolopyridinyl, oxazolopyridinyl, thiazolopyridinyl, imidazopyrazinyl, imidazopyrimidinyl, thienopyrimidinyl, furopyrimidinyl, pyrrolopyrimidinyl, pyrazolopyrimidinyl, oxazolopyrimidinyl, thiazolopyrimidinyl, pyrazolotriazinyl, naphtho[2,3-b]thienyl, phenoxathiinyl, indolyl, isoindolyl, 1H-indazolyl, purinyl, isoquinolyl, quinolyl, phthalazinyl, naphthyridinyl, quinoxalinyl, quinazolinyl, cinnolinyl, carbazolyl, β-carbolinyl, phenanthridinyl, acridinyl, phenazinyl, phenothiazinyl, phenoxazinyl and the like.

In the present specification, examples of the "non-aromatic heterocyclic group" (including "3- to 14-membered non-aromatic heterocyclic group") include a 3- to 14-membered (preferably 4- to 10-membered) non-aromatic heterocyclic group containing, as a ring-constituting atom besides carbon atom, 1 to 4 hetero atoms selected from a nitrogen atom, a sulfur atom and an oxygen atom.

Preferable examples of the "non-aromatic heterocyclic group" include 3- to 8-membered monocyclic non-aromatic heterocyclic groups such as aziridinyl, oxiranyl, thiiranyl, azetidinyl, oxetanyl, thietanyl, tetrahydrothienyl, tetrahydrofuranyl, pyrrolinyl, pyrrolidinyl, imidazolinyl, imidazolidinyl, oxazolinyl, oxazolidinyl, pyrazolinyl, pyrazolidinyl, thiazolinyl, thiazolidinyl, tetrahydroisothiazolyl, tetrahydrooxazolyl, tetrahydroisooxazolyl, piperidinyl, piperazinyl, tetrahydropyridinyl, dihydropyridinyl, dihydrothiopyranyl, tetrahydropyrimidinyl, tetrahydropyridazinyl, dihydropyranyl, tetrahydropyranyl, tetrahydrothiopyranyl, morpholinyl, thiomorpholinyl, azepanyl, diazepanyl, azepinyl, oxepanyl, azocanyl, diazocanyl and the like; and 9- to 14-membered fused polycyclic (preferably bi or tricyclic) non-aromatic heterocyclic groups such as dihydrobenzofuranyl, dihydrobenzimidazolyl, dihydrobenzoxazolyl, dihydrobenzothiazolyl, dihydrobenzisothiazolyl, dihydronaphtho[2,3-b]thienyl, tetrahydroisoquinolyl, tetrahydroquinolyl, 4H-quinolizinyl, indolinyl, isoindolinyl, tetrahydrothieno[2,3-c]pyridinyl, tetrahydrobenzazepinyl, tetrahydroquinoxalinyl, tetrahydrophenanthridinyl, hexahydrophenothiazinyl, hexahydrophenoxazinyl, tetrahydrophthalazinyl, tetrahydronaphthyridinyl, tetrahydroquinazolinyl, tetrahydrocinnolinyl, tetrahydrocarbazolyl, tetrahydro-β-carbolinyl, tetrahydroacrydinyl, tetrahydrophenazinyl, tetrahydrothioxanthenyl, octahydroisoquinolyl and the like.

In the present specification, preferable examples of the "7- to 10-membered bridged heterocyclic group" include quinuclidinyl and 7-azabicyclo[2.2.1]heptanyl.

In the present specification, examples of the "nitrogen-containing heterocyclic group" include a "heterocyclic group" containing at least one nitrogen atom as a ring-constituting atom.

In the present specification, examples of the "optionally substituted heterocyclic group" include a heterocyclic group optionally having substituent(s) selected from the aforementioned substituent group A.

The number of the substituents in the "optionally substituted heterocyclic group" is, for example, 1 to 3. When the number of the substituents is two or more, the respective substituents may be the same or different.

In the present specification, examples of the "acyl group" include a formyl group, a carboxy group, a carbamoyl group, a thiocarbamoyl group, a sulfino group, a sulfo group, a sulfamoyl group and a phosphono group, each optionally having "1 or 2 substituents selected from a $C_{1-6}$ alkyl group, a $C_{2-6}$ alkenyl group, a $C_{3-10}$ cycloalkyl group, a $C_{3-6}$ cycloalkenyl group, a $C_{6-14}$ aryl group, a $C_{7-16}$ aralkyl group, a 5- to 14-membered aromatic heterocyclic group and a 3- to 14-membered non-aromatic heterocyclic group, each of which optionally has 1 to 3 substituents selected from a halogen atom, an optionally halogenated $C_{1-6}$ alkoxy group, a hydroxy group, a nitro group, a cyano group, an amino group and a carbamoyl group".

Examples of the "acyl group" (also referred to as "Ac") also include a hydrocarbon-sulfonyl group, a heterocyclylsulfonyl group, a hydrocarbon-sulfinyl group and a heterocyclylsulfinyl group.

In some embodiments, the hydrocarbon-sulfonyl group means a hydrocarbon group-bonded sulfonyl group, the heterocyclylsulfonyl group means a heterocyclic group-bonded sulfonyl group, the hydrocarbon-sulfinyl group means a hydrocarbon group-bonded sulfinyl group and the heterocyclylsulfinyl group means a heterocyclic group-bonded sulfinyl group.

Preferable examples of the "acyl group" include a formyl group, a carboxy group, a $C_{1-6}$ alkyl-carbonyl group, a $C_{2-6}$ alkenyl-carbonyl group (e.g., crotonoyl), a $C_{3-10}$ cycloalkyl-carbonyl group (e.g., cyclobutanecarbonyl, cyclopentanecarbonyl, cyclohexanecarbonyl, cycloheptanecarbonyl), a $C_{3-10}$ cycloalkenyl-carbonyl group (e.g., 2-cyclohexenecarbonyl), a $C_{6-14}$ aryl-carbonyl group, a $C_{7-16}$ aralkyl-carbonyl group, a 5- to 14-membered aromatic heterocyclylcarbonyl group, a 3- to 14-membered non-aromatic heterocyclylcarbonyl group, a $C_{1-6}$ alkoxy-carbonyl group, a $C_{6-14}$ aryloxy-carbonyl group (e.g., phenyloxycarbonyl, naphthyloxycarbonyl), a $C_{7-16}$ aralkyloxy-carbonyl group (e.g., benzyloxycarbonyl, phenethyloxycarbonyl), a carbamoyl group, a mono- or di-$C_{1-6}$ alkyl-carbamoyl group, a mono- or di-$C_{2-6}$ alkenyl-carbamoyl group (e.g., diallylcarbamoyl), a mono- or di-$C_{3-10}$ cycloalkyl-carbamoyl group (e.g., cyclopropylcarbamoyl), a mono- or di-$C_{6-14}$ aryl-carbamoyl group (e.g., phenylcarbamoyl), a mono- or di-$C_{7-16}$ aralkyl-carbamoyl group, a 5- to 14-membered aromatic heterocyclylcarbamoyl group (e.g., pyridylcarbamoyl), a thiocarbamoyl group, a mono- or di-$C_{1-6}$ alkyl-thiocarbamoyl group (e.g., methylthiocarbamoyl, N-ethyl-N-methylthiocarbamoyl), a mono- or di-$C_{2-6}$ alkenyl-thiocarbamoyl group (e.g., diallylthiocarbamoyl), a mono- or di-$C_{3-10}$ cycloalkyl-thiocarbamoyl group (e.g., cyclopropylthiocarbamoyl, cyclohexylthiocarbamoyl), a mono- or di-$C_{6-14}$ aryl-thiocarbamoyl group (e.g., phenylthiocarbamoyl), a mono- or di-$C_{7-16}$ aralkyl-thiocarbamoyl group (e.g., benzylthiocarbamoyl, phenethylthiocarbamoyl), a 5- to 14-membered aromatic heterocyclylthiocarbamoyl group (e.g., pyridylthiocarbamoyl), a sulfino group, a $C_{1-6}$ alkylsulfinyl group (e.g., methylsulfinyl, ethylsulfinyl), a sulfo group, a $C_{1-6}$ alkylsulfonyl group, a $C_{6-14}$ arylsulfonyl group, a phosphono group and a mono- or di-$C_{1-6}$ alkylphosphono group (e.g., dimethylphosphono, diethylphosphono, diisopropylphosphono, dibutylphosphono).

In the present specification, examples of the "optionally substituted amino group" include an amino group optionally having "1 or 2 substituents selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5- to 14-membered aromatic heterocyclylcarbonyl group, a 3- to 14-membered non-aromatic heterocyclylcarbonyl group, a $C_{1-6}$ alkoxy-carbonyl group, a 5- to 14-membered aromatic heterocyclic group, a carbamoyl group, a mono- or di-$C_{1-6}$ alkyl-carbamoyl group, a mono- or di-$C_{7-16}$ aralkyl-carbamoyl group, a $C_{1-6}$ alkylsulfonyl group and a $C_{6-14}$ arylsulfonyl group, each of which optionally has 1 to 3 substituents selected from substituent group A".

Preferable examples of the optionally substituted amino group include an amino group, a mono- or di-(optionally halogenated $C_{1-6}$ alkyl)amino group (e.g., methylamino, trifluoromethylamino, dimethylamino, ethylamino, diethylamino, propylamino, dibutylamino), a mono- or di-$C_{2-6}$ alkenylamino group (e.g., diallylamino), a mono- or di-$C_{3-10}$ cycloalkylamino group (e.g., cyclopropylamino, cyclohexylamino), a mono- or di-$C_{6-14}$ arylamino group (e.g., phenylamino), a mono- or di-$C_{7-16}$ aralkylamino group (e.g., benzylamino, dibenzylamino), a mono- or di-(optionally halogenated $C_{1-6}$ alkyl)-carbonylamino group (e.g., acetylamino, propionylamino), a mono- or di-$C_{6-14}$ aryl-carbonylamino group (e.g., benzoylamino), a mono- or di-$C_{7-16}$ aralkyl-carbonylamino group (e.g., benzylcarbonylamino), a mono- or di-5- to 14-membered aromatic heterocyclylcarbonylamino group (e.g., nicotinoylamino, isonicotinoylamino), a mono- or di-3- to 14-membered non-aromatic heterocyclylcarbonylamino group (e.g., piperidinylcarbonylamino), a mono- or di-$C_{1-6}$ alkoxy-carbonylamino group (e.g., tert-butoxycarbonylamino), a 5- to 14-membered aromatic heterocyclylamino group (e.g., pyridylamino), a carbamoylamino group, a (mono- or di-$C_{1-6}$ alkyl-carbamoyl) amino group (e.g., methylcarbamoylamino), a (mono- or di-$C_{7-16}$ aralkyl-carbamoyl)amino group (e.g., benzylcarbamoylamino), a $C_{1-6}$ alkylsulfonylamino group (e.g., methylsulfonylamino, ethylsulfonylamino), a $C_{6-14}$ arylsulfonylamino group (e.g., phenylsulfonylamino), a ($C_{1-6}$ alkyl)($C_{1-6}$ alkyl-carbonyl)amino group (e.g., N-acetyl-N-methylamino) and a ($C_{1-6}$ alkyl)($C_{6-14}$ aryl-carbonyl)amino group (e.g., N-benzoyl-N-methylamino).

In the present specification, examples of the "optionally substituted carbamoyl group" include a carbamoyl group optionally having "1 or 2 substituents selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5- to 14-membered aromatic heterocyclylcarbonyl group, a 3- to 14-membered non-aromatic heterocyclylcarbonyl group, a $C_{1-6}$ alkoxy-carbonyl group, a 5- to 14-membered aromatic heterocyclic group, a carbamoyl group, a mono- or di-$C_{1-6}$ alkyl-carbamoyl group and a mono- or di-$C_{7-16}$ aralkyl-carbamoyl group, each of which optionally has 1 to 3 substituents selected from substituent group A".

Preferable examples of the optionally substituted carbamoyl group include a carbamoyl group, a mono- or di-$C_{1-6}$ alkyl-carbamoyl group, a mono- or di-$C_{2-6}$ alkenyl-carbamoyl group (e.g., diallylcarbamoyl), a mono- or di-$C_{3-10}$ cycloalkyl-carbamoyl group (e.g., cyclopropylcarbamoyl, cyclohexylcarbamoyl), a mono- or di-$C_{6-14}$ aryl-carbamoyl group (e.g., phenylcarbamoyl), a mono- or di-$C_{7-16}$ aralkyl-carbamoyl group, a mono- or di-$C_{1-6}$ alkyl-carbonyl-carbamoyl group (e.g., acetylcarbamoyl, propionylcarbamoyl), a mono- or di-$C_{6-14}$ aryl-carbonyl-carbamoyl group (e.g., benzoylcarbamoyl) and a 5- to 14-membered aromatic heterocyclylcarbamoyl group (e.g., pyridylcarbamoyl).

In the present specification, examples of the "optionally substituted thiocarbamoyl group" include a thiocarbamoyl group optionally having "1 or 2 substituents selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5- to 14-membered aromatic heterocyclylcarbonyl group, a 3- to 14-membered non-aromatic heterocyclylcarbonyl group, a $C_{1-6}$ alkoxy-carbonyl group, a 5- to 14-membered aromatic heterocyclic group, a carbamoyl group, a mono- or di-$C_{1-6}$ alkyl-carbamoyl group and a mono- or di-$C_{7-16}$ aralkyl-carbamoyl group, each of which optionally has 1 to 3 substituents selected from substituent group A".

Preferable examples of the optionally substituted thiocarbamoyl group include a thiocarbamoyl group, a mono- or di-$C_{1-6}$ alkyl-thiocarbamoyl group (e.g., methylthiocarbamoyl, ethylthiocarbamoyl, dimethylthiocarbamoyl, diethylthiocarbamoyl, N-ethyl-N-methylthiocarbamoyl), a mono- or di-$C_{2-6}$ alkenyl-thiocarbamoyl group (e.g., diallylthiocarbamoyl), a mono- or di-$C_{3-10}$ cycloalkyl-thiocarbamoyl group (e.g., cyclopropylthiocarbamoyl, cyclohexylthiocarbamoyl), a mono- or di-$C_{6-14}$ aryl-thiocarbamoyl group (e.g., phenylthiocarbamoyl), a mono- or di-$C_{7-16}$ aralkyl-thiocarbamoyl group (e.g., benzylthiocarbamoyl, phenethylthiocarbamoyl), a mono- or di-$C_{1-6}$ alkyl-carbonyl-thiocarbamoyl group (e.g., acetylthiocarbamoyl, propionylthiocarbamoyl), a mono- or di-$C_{6-14}$ aryl-carbonyl-thiocarbamoyl group (e.g., benzoylthiocarbamoyl) and a 5- to 14-membered aromatic heterocyclylthiocarbamoyl group (e.g., pyridylthiocarbamoyl).

In the present specification, examples of the "optionally substituted sulfamoyl group" include a sulfamoyl group optionally having "1 or 2 substituents selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5- to 14-membered aromatic heterocyclylcarbonyl group, a 3- to 14-membered non-aromatic heterocyclylcarbonyl group, a $C_{1-6}$ alkoxy-carbonyl group, a 5- to 14-membered aromatic heterocyclic group, a carbamoyl group, a mono- or di-$C_{1-6}$ alkyl-carbamoyl group and a mono- or di-$C_{7-16}$ aralkyl-carbamoyl group, each of which optionally has 1 to 3 substituents selected from substituent group A".

Preferable examples of the optionally substituted sulfamoyl group include a sulfamoyl group, a mono- or di-$C_{1-6}$ alkyl-sulfamoyl group (e.g., methylsulfamoyl, ethylsulfamoyl, dimethylsulfamoyl, diethylsulfamoyl, N-ethyl-N-methylsulfamoyl), a mono- or di-$C_{2-6}$ alkenyl-sulfamoyl group (e.g., diallylsulfamoyl), a mono- or di-$C_{3-10}$ cycloalkyl-sulfamoyl group (e.g., cyclopropylsulfamoyl, cyclohexylsulfamoyl), a mono- or di-$C_{6-14}$ aryl-sulfamoyl group (e.g., phenylsulfamoyl), a mono- or di-$C_{7-16}$ aralkyl-sulfamoyl group (e.g., benzylsulfamoyl, phenethylsulfamoyl), a mono- or di-$C_{1-6}$ alkyl-carbonyl-sulfamoyl group (e.g., acetylsulfamoyl, propionylsulfamoyl), a mono- or di-$C_{6-14}$ aryl-carbonyl-sulfamoyl group (e.g., benzoylsulfamoyl) and a 5- to 14-membered aromatic heterocyclylsulfamoyl group (e.g., pyridylsulfamoyl).

In the present specification, examples of the "optionally substituted hydroxy group" include a hydroxyl group optionally having "a substituent selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5- to 14-membered aromatic heterocyclylcarbonyl group, a 3- to 14-membered non-aromatic heterocyclylcarbonyl group, a $C_{1-6}$ alkoxy-carbonyl group, a 5- to 14-membered aromatic heterocyclic group, a carbamoyl group, a mono- or di-$C_{1-6}$ alkyl-carbamoyl group, a mono- or di-$C_{7-16}$ aralkyl-carbamoyl group, a $C_{1-6}$ alkylsulfonyl group and a $C_{6-14}$ arylsulfonyl group, each of which optionally has 1 to 3 substituents selected from substituent group A".

Preferable examples of the optionally substituted hydroxy group include a hydroxy group, a $C_{1-6}$ alkoxy group, a $C_{2-6}$ alkenyloxy group (e.g., allyloxy, 2-butenyloxy, 2-pentenyloxy, 3-hexenyloxy), a $C_{3-10}$ cycloalkyloxy group (e.g., cyclohexyloxy), a $C_{6-14}$ aryloxy group (e.g., phenoxy, naphthyloxy), a $C_{7-16}$ aralkyloxy group (e.g., benzyloxy, phenethyloxy), a $C_{1-6}$ alkyl-carbonyloxy group (e.g., acetyloxy, propionyloxy, butyryloxy, isobutyryloxy, pivaloyloxy), a $C_{6-14}$ aryl-carbonyloxy group (e.g., benzoyloxy), a $C_{7-16}$ aralkyl-carbonyloxy group (e.g., benzylcarbonyloxy), a 5- to 14-membered aromatic heterocyclylcarbonyloxy group (e.g., nicotinoyloxy), a 3- to 14-membered non-aromatic heterocyclylcarbonyloxy group (e.g., piperidinylcarbonyloxy), a $C_{1-6}$ alkoxy-carbonyloxy group (e.g., tert-butoxycarbonyloxy), a 5- to 14-membered aromatic heterocyclyloxy group (e.g., pyridyloxy), a carbamoyloxy group, a $C_{1-6}$ alkyl-carbamoyloxy group (e.g., methylcarbamoyloxy), a $C_{7-16}$ aralkyl-carbamoyloxy group (e.g., benzylcarbamoyloxy), a $C_{1-6}$ alkylsulfonyloxy group (e.g., methylsulfonyloxy, ethylsulfonyloxy) and a $C_{6-14}$ arylsulfonyloxy group (e.g., phenylsulfonyloxy).

In the present specification, examples of the "optionally substituted sulfanyl group" include a sulfanyl group optionally having "a substituent selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group and a 5- to 14-membered aromatic heterocyclic group, each of which optionally has 1 to 3 substituents selected from substituent group A" and a halogenated sulfanyl group.

Preferable examples of the optionally substituted sulfanyl group include a sulfanyl (—SH) group, a $C_{1-6}$ alkylthio group, a $C_{2-6}$ alkenylthio group (e.g., allylthio, 2-butenylthio, 2-pentenylthio, 3-hexenylthio), a $C_{3-10}$ cycloalkylthio group (e.g., cyclohexylthio), a $C_{6-14}$ arylthio group (e.g., phenylthio, naphthylthio), a $C_{7-16}$ aralkylthio group (e.g., benzylthio, phenethylthio), a $C_{1-6}$ alkyl-carbonylthio group (e.g., acetylthio, propionylthio, butyrylthio, isobutyrylthio, pivaloylthio), a $C_{6-14}$ aryl-carbonylthio group (e.g., benzoylthio), a 5- to 14-membered aromatic heterocyclylthio group (e.g., pyridylthio) and a halogenated thio group (e.g., pentafluorothio).

In the present specification, examples of the "optionally substituted silyl group" include a silyl group optionally having "1 to 3 substituents selected from a $C_{1-6}$ alkyl group, a $C_{2-6}$ alkenyl group, a $C_{3-10}$ cycloalkyl group, a $C_{6-14}$ aryl group and a $C_{7-16}$ aralkyl group, each of which optionally has 1 to 3 substituents selected from substituent group A".

Preferable examples of the optionally substituted silyl group include a tri-$C_{1-6}$ alkylsilyl group (e.g., trimethylsilyl, tert-butyl(dimethyl)silyl).

For descriptions of amino acid residues, the following conventions may be exemplified: Asp-D-Aspartic Acid; Ala=A=Alanine; Arg=R=Arginine; Asn-N-Asparagine; Cys=C-Cysteine; Gly-G-Glycine; Glu=E=Glutamic Acid; Gln=Q-Glutamine; His=H=Histidine; Ile=I=Isoleucine; Leu=L=Leucine; Lys=K=Lysine; Met=M=Methionine; Phe=F=Phenylalanine; Pro=P=Proline; Ser-S-Serine; Thr=T=Threonine; Trp=W=Tryptophan; Tyr=Y=Tyrosine; and Val=V=Valine.

Also for convenience, and readily known to one skilled in the art, the following abbreviations or symbols are used to represent the moieties, reagents and the like used in present disclosure:
  mono-halo Phe mono-halo phenylalanine;
  bis-halo Phe-bis-halo phenylalanine;
  mono-halo Tyr-mono-halo tyrosine;
  bis-halo Tyr-bis-halo Tyrosine;
  (D)-Tyr-D-tyrosine;
  (D)-Ala-D-Alanine
  DesNH$_2$-Tyr-desaminotyrosine;
  (D)-Phe-D-phenylalanine;
  DesNH$_2$-Phe-desaminophenylalanine;
  (D)-Trp-D-tryptophan;
  (D)$_3$Pya-D-3-pyridylalanine;
  2-Cl-(D)Phe-D-2-chlorophenylalanine;
  3-Cl-(D)Phe-D-3-chlorophenylalanine;
  4-Cl-(D)Phe-D-4-chlorophenylalanine;
  2-F-(D)Phe-D-2-fluorophenylalanine;
  3-F(D)Phe-D-3-fluorophenylalanine;
  3,5-DiF-(D)Phe-D-3,5-difluorophenylalanine;
  3,4,5-TriF-(D)Phe-D-3,4,5-trifluorophenylalanine;
  D-Iva-D-Isovaline
  SSA-succinimidyl succinamide;
  PEG-polyethylene glycol;
  PEG$_m$-(methoxy)polyethylene glycol;
  PEG$_m$(12,000)-(methoxy)polyethylene glycol having a molecular weight of about 12 kD;
  PEG$_m$(20,000)-(methoxy)polyethylene glycol having a molecular weight of about 20 kD;
  PEG$_m$(30,000)-(methoxy)polyethylene glycol having a molecular weight of about 30 kD;
  Fmoc-9-fluorenylmethyloxycarbonyl;
  DMF-dimethylformamide;
  DIPEA-N,N-diisopropylethylamine;
  TFA-trifluoroacetic acid;
  HOBT-N-hydroxybenzotriazole;
  BOP-benzotriazol-1-yloxy-tris-(dimethylamino)phosphonium-hexafluorophosphate;
  HBTU-2-(1H-benzotriazole-1-yl)-1,1,3,3-tetramethyl-uronium-hexafluorophosphate;
  NMP-N-methyl-pyrrolidone;
  FAB-MS fast atom bombardment mass spectrometry;
  ES-MS-electro spray mass spectrometry.
  Abu: α-aminobutyric acid;
  Acc: 1-amino-1-cyclo($C_3$-$C_9$)alkyl carboxylic acid;
  A3c: 1-amino-1-cyclopropane carboxylic acid;
  A4c: 1-amino-1-cyclobutanecarboxylic acid;
  A5c: 1-amino-1-cyclopentanecarboxylic acid;
  A6c: 1-amino-1-cyclohexanecarboxylic acid;
  Act: 4-amino-4-carboxytetrahydropyran;
  Ado: 12-aminododecanoic acid;
  Aib: .alpha.-aminoisobutyric acid;
  Aic: 2-aminoindan-2-carboxylic acid;
  β-Ala: beta-alanine;
  Amp: 4-amino-phenylalanine;
  Apc: 4-amino-4-carboxypiperidine;
  hArg: homoarginine;
  Aun: 11-aminoundecanoic acid;
  Ava: 5-aminovaleric acid;
  Cha: β-cyclohexylalanine;
  Dhp: 3,4-dehydroproline;
  Dmt: 5,5-dimethylthiazolidine-4-carboxylic acid;
  Gaba: γ-aminobutyric acid;
  4Hppa: 3-(4-hydroxyphenyl)propionic acid;
  Hyp: -hydroxyproline
  3Hyp: 3-hydroxyproline;
  4Hyp: 4-hydroxyproline;
  hPro: homoproline;
  4Ktp: 4-ketoproline;
  Nle: norleucine;
  NMe-Tyr: N-methyl-tyrosine;
  1Nal or 1-Nal: β-(1-naphthyl)alanine;
  2Nal or 2-Nal: β-(2-naphthyl)alanine;
  Nva: norvaline;
  Orn: ornithine;
  2Pal or 2-Pal: β-(2-pyridinyl)alanine;
  3Pal or 3-Pal: β-(3-pyridinyl)alanine;
  4Pal or 4-Pal: β-(4-pyridinyl)alanine;
  Pen: penicillamine;
  (3,4,5F)Phe: 3,4,5-trifluorophenylalanine;
  (2,3,4,5,6)Phe: 2,3,4,5,6-pentafluorophenylalanine;
  Psu: N-propylsuccinimide;
  Iva: Isovaline;
  Sar: Sarcosine;
  Taz: β-(4-thiazolyl)alanine;
  3 Thi: β-(3-thienyl)alanine;
  Thz: thioproline;
  Tic: tetrahydroisoquinoline-3-carboxylic acid;
  Tle: tert-leucine;
  Act: acetonitrile;
  Boc: tert-butyloxycarbonyl;
  BSA: bovine serum albumin;
  DCM: dichloromethane;
  DTT: dithiothrieitol;
  ESI: electrospray ionization;
  Fmoc: 9-fluorenylmethyloxycarbonyl;
  HBTU: 2-(1H-benzotriazole-1-yl)-1,1,3,3-tetramethyl-uronium hexafluorophosphate;
  HPLC: high performance liquid chromatography;
  IBMX: isobutylmethylxanthine;
  LC-MS: liquid chromatography-mass spectrometry;
  Mtt: methyltrityl;
  NMP: N-methylpyrrolidone;
  5K PEG: polyethylene glycol, which may include other functional groups or moieties such as a linker, and which is either linear or branched as defined hereinbelow, with a weight average molecular weight of about 5,000 Daltons.
  10K PEG: polyethylene glycol, which may include other functional groups or moieties such as a linker, and which is either linear or branched as defined hereinbelow, with a weight average molecular weight of about 10,000 Daltons.

20K PEG: polyethylene glycol, which may include other functional groups or moieties such as a linker, and which is either linear or branched as defined hereinbelow, with a weight average molecular weight of about 20,000 Daltons.

30K PEG: polyethylene glycol, which may include other functional groups or moieties such as a linker, and which is either linear or branched as defined hereinbelow, with a weight average molecular weight of about 30,000 Daltons.

40K PEG: polyethylene glycol, which may include other functional groups or moieties such as a linker, and which is either linear or branched as defined hereinbelow, with a weight average molecular weight of about 40,000 Daltons.

50K PEG: polyethylene glycol, which may include other functional groups or moieties such as a linker, and which is either linear or branched as defined hereinbelow, with a weight average molecular weight of about 50,000 Daltons.

60K PEG: polyethylene glycol, which may include other functional groups or moieties such as a linker, and which is either linear or branched as defined hereinbelow, with a weight average molecular weight of about 60,000 Daltons.

PEG is available in a variety of molecular weights based on the number of repeating subunits of ethylene oxide (i.e. —$OCH_2CH_2$—) within the molecule. mPEG formulations are usually followed by a number that corresponds to their average molecular weight. For example, PEG-200 has a weight average molecular weight of 200 Daltons and may have a molecular weight range of 190-210 Daltons. Molecular weight in the context of a water-soluble polymer, such as PEG, can be expressed as either a number average molecular weight or a weight average molecular weight. Unless otherwise indicated, all references to molecular weight of mPEG herein refer to the weight average molecular weight. Both molecular weight determinations, number average and weight average, can be measured using gel permeation chromatography or other liquid chromatography techniques. Other methods for measuring molecular weight values can also be used, such as the use of end-group analysis or the measurement of colligative properties (e.g., freezing-point depression, boiling-point elevation, or osmotic pressure) to determine number average molecular weight or the use of light scattering techniques, ultracentrifugation or viscometry to determine weight average molecular weight.

tBu: tert-butyl
TIS: triisopropylsilane
Trt: trityl
Z: benzyloxycarbonyl

As used herein, "PEG moiety" refers to polyethylene glycol (PEG) or a derivative thereof, for example (methoxy) polyethylene glycol ($PEG_m$).

As used herein, "PEGylated peptide" refers to a peptide wherein at least one amino acid residue, for example, Lys, or Cys has been conjugated with a PEG moiety. By "conjugated", it is meant that the PEG moiety is either directly linked to said residue or is linked to the residue via a spacer moiety, for example a cross-linking agent. When said conjugation is at a lysine residue, that lysine residue is referred to herein as "PEGylated Lys". A peptide that is conjugated to only one MPEG moiety is said to be "mono-PEGylated".

As used herein, "Lys-PEG" and "Lys-$PEG_m$" refer respectively to lysine residues which have been conjugated with PEG. "Lys(epsilon-SSA-PEGn)" refers to a lysine residue wherein the epsilon-amino group has been cross-linked with MPEG using a suitably functionalized SSA.

In the present specification, the term "human native GIP peptide" refers to the naturally occurring human GIP peptide. This human native GIP peptide (42 amino acids) has an amino acid sequence: YAEGTFISDYSIAMDKIHQ QDFVNWLLAQKGKKNDWKHNITQ (SEQ ID NO: 1) and is the functionally active molecule derived from the parent precursor described in National Center for Biotechnology Information (NCBI) Reference Sequence: NP_004114.1; REFSEQ: accession NM_004123.2 (SEQ ID NO: 2). This full length precursor is encoded from the mRNA sequence of human gastric inhibitory polypeptide (GIP), mRNA; ACCESSION: NM_004123; VERSION; NM_004123.2 (SEQ ID NO: 3).

"Percent (%) amino acid sequence identity" with respect to a reference polypeptide sequence is defined as the percentage of amino acid residues in a candidate polypeptide sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared.

As used herein, "treatment" (and variations such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of a condition, alleviation of symptoms, diminishment of any direct or indirect pathological consequences of the condition or treatment, preventing emesis, i.e., by preventing the occurrence of symptoms in whole or in part associated with a condition or side-effects known to accompany a specific treatment, decreasing the rate of progression, amelioration or palliation of the symptoms associated with emesis, such as nausea and/or vomiting, and remission or improved prognosis. In some embodiments, GIP receptor agonist peptides of the disclosure are used to inhibit or delay development of emesis, ie. nausea or vomiting or to slow the progression of emesis or the symptoms associated with emesis, or to prevent, delay or inhibit the development of emesis, nausea and/or vomiting related to the treatment of a different disease being actively treated.

By "reduce" or "inhibit" is meant the ability to cause an overall decrease of 20%, 30%, 40%, 50%, 60%, 70%, 75%, 80%, 85%, 90%, 95%, or greater. In some embodiments, reduce or inhibit can refer to a relative reduction compared to a reference (e.g., reference level of biological activity (e.g., the number of episodes of nausea and/or vomiting after administration to a subject of a prescribed amount of chemotherapy, for example, a prescribed dose of a chemotherapeutic agent that is known to cause emesis). In some embodiments, reduce or inhibit can refer to the relative reduction of a side effect (i.e. nausea and/or vomiting) associated with a treatment for a condition or disease.

Optimal alignment of sequences for comparison can be conducted, for example, by the local homology algorithm of Smith and Waterman (Adv. Appl. Math. 2:482 (1981), which is incorporated by reference herein), by the homology alignment algorithm of Needleman and Wunsch (J. Mol. Biol. 48:443-53 (1970), which is incorporated by reference herein), by the search for similarity method of Pearson and Lipman (Proc. Natl. Acad. Sci. USA 85:2444-48 (1988), which is incorporated by reference herein), by computerized implementations of these algorithms (e.g., GAP, BESTFIT, FASTA, and TFASTA in the Wisconsin Genetics Software Package, Genetics Computer Group, 575 Science Dr., Madison, Wis.), or by visual inspection. (See generally Ausubel et al. (eds.), Current Protocols in Molecular Biology, 4th ed., John Wiley and Sons, New York (1999)).

One illustrative example of an algorithm that is suitable for determining percent sequence identity and sequence similarity is the BLAST algorithm, which is described by Altschul et al. (J. Mol. Biol. 215:403-410 (1990), which is incorporated by reference herein). (See also Zhang et al., Nucleic Acid Res. 26:3986-90 (1998); Altschul et al., Nucleic Acid Res. 25:3389-402 (1997), which are incorporated by reference herein). Software for performing BLAST analyses is publicly available through the National Center for Biotechnology Information internet web site. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al. (1990), supra). These initial neighborhood word hits act as seeds for initiating searches to find longer HSPs containing them. The word hits are then extended in both directions along each sequence for as far as the cumulative alignment score can be increased. Extension of the word hits in each direction is halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLAST program uses as defaults a word length (W) of 11, the BLOSUM62 scoring matrix (see Henikoff and Henikoff, Proc. Natl. Acad. Sci. USA 89:10915-9 (1992), which is incorporated by reference herein) alignments (B) of 50, expectation (E) of 10, M=5, N=−4, and a comparison of both strands.

In addition to calculating percent sequence identity, the BLAST algorithm also performs a statistical analysis of the similarity between two sequences (see, e.g., Karlin and Altschul, Proc. Natl. Acad. Sci. USA 90:5873-77 (1993), which is incorporated by reference herein). One measure of similarity provided by the BLAST algorithm is the smallest sum probability (P(N)), which provides an indication of the probability by which a match between two nucleotide or amino acid sequences would occur by chance. For example, an amino acid sequence is considered similar to a reference amino acid sequence if the smallest sum probability in a comparison of the test amino acid to the reference amino acid is less than about 0.1, more typically less than about 0.01, and most typically less than about 0.001.

Variants can also be synthetic, recombinant, or chemically modified polynucleotides or polypeptides isolated or generated using methods well known in the art. Variants can include conservative or non-conservative amino acid changes, as described below. Polynucleotide changes can result in amino acid substitutions, additions, deletions, fusions and truncations in the polypeptide encoded by the reference sequence. Variants can also include insertions, deletions or substitutions of amino acids, including insertions and substitutions of amino acids and other molecules) that do not normally occur in the peptide sequence that is the basis of the variant, for example but not limited to insertion of ornithine which do not normally occur in human proteins. The term "conservative substitution," when describing a polypeptide, refers to a change in the amino acid composition of the polypeptide that does not substantially alter the polypeptide's activity. For example, a conservative substitution refers to substituting an amino acid residue for a different amino acid residue that has similar chemical properties. Conservative amino acid substitutions include replacement of a leucine with an isoleucine or valine, an aspartate with a glutamate, or a threonine with a serine.

"Conservative amino acid substitutions" as referenced herein result from replacing one amino acid with another having similar structural and/or chemical properties, such as the replacement of a leucine with an isoleucine or valine, an aspartate with a glutamate, or a threonine with a serine. Thus, a "conservative substitution" of a particular amino acid sequence refers to substitution of those amino acids that are not critical for polypeptide activity or substitution of amino acids with other amino acids having similar properties (e.g., acidic, basic, positively or negatively charged, polar or non-polar, etc.) such that the substitution of even critical amino acids does not reduce the activity of the peptide, (i.e. the ability of the peptide to penetrate the blood brain barrier (BBB)). Conservative substitution tables providing functionally similar amino acids are well known in the art. For example, the following six groups each contain amino acids that are conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); and 6) Phenylalanine (F), Tyrosine (Y), Tryptophan (W). (See also Creighton, Proteins, W. H. Freeman and Company (1984), incorporated by reference in its entirety.) In some embodiments, individual substitutions, deletions or additions that alter, add or delete a single amino acid or a small percentage of amino acids can also be considered "conservative substitutions" if the change does not reduce the activity of the peptide. Insertions or deletions are typically in the range of about 1 to 5 amino acids. The choice of conservative amino acids may be selected based on the location of the amino acid to be substituted in the peptide, for example if the amino acid is on the exterior of the peptide and expose to solvents, or on the interior and not exposed to solvents.

In alternative embodiments, one can also select conservative amino acid substitutions encompassed suitable for amino acids on the interior of a protein or peptide, for example one can use suitable conservative substitutions for amino acids is on the interior of a protein or peptide (i.e., the amino acids are not exposed to a solvent), for example but not limited to, one can use the following conservative substitutions: where Y is substituted with F, T with A or S, I with L or V, W with Y, M with L, N with D, G with A, T with A or S, D with N, I with L or V, F with Y or L, S with A or T and A with S, G, T or V. In some embodiments, non-conservative amino acid substitutions are also encompassed within the term of variants.

As used herein, the term "selectivity" of a molecule for a first receptor relative to a second receptor refers to the following ratio: $EC_{50}$ of the molecule at the second receptor divided by the $EC_{50}$ of the molecule at the first receptor. For example, a molecule that has an $EC_{50}$ of 1 nM at a first receptor and an $EC_{50}$ of 100 nM at a second receptor has 100-fold selectivity for the first receptor relative to the second receptor.

As is understood by one skilled in the art, reference to "about" a value or parameter herein includes (and describes) embodiments that are directed to that value or parameter per se or that have a variance plus or minus of that value ranging from less than 10%, or less than 9%, or less than 8%, or less 7%, or less than 6%, or less than 5%, or less than 4%, or less than 3%, or less than 2%, or less than 1%, or less than 0.1% than the stated value. For example, description referring to "about X" includes description of "X".

It is understood that aspect and embodiments of the disclosure described herein include "consisting" and/or "consisting essentially" of aspects and embodiments. As used herein, the singular form "a", "an", and "the" includes plural references unless indicated otherwise.

A. GIP RECEPTOR AGONIST PEPTIDES

In various embodiments of the present disclosure, GIP receptor agonist peptides are provided. In addition, methods are provided for the prevention and/or treatment of diabetes mellitus (e.g., type-2 diabetes mellitus) obesity, a metabolic syndrome and emesis in a subject in need thereof. In various embodiments, the methods provide administration of a therapeutically effective amount of a GIP receptor agonist peptide to the subject.

As used herein, GIP agonist peptides of the present disclosure refer to peptides that preferentially bind to GIP receptors compared to other receptors, such as GLP receptors. In some embodiments, an exemplary GIP agonist peptide of the present disclosure are GIP agonist peptides that have a selectivity ratio as defined as the ratio of ($EC_{50}$ GLP1R/$EC_{50}$ GIPR) greater than 10, or greater than 100, or greater than 1,000, or greater than 10,000, or greater than 100,000. Preferably, an exemplary GIP receptor agonist peptide is a GIP agonist peptide when the peptide has a selectivity ratio of ($EC_{50}$ GLP1R/$EC_{50}$ GIPR) of greater than 10, or 100, or 1,000, or 10,000, or from about 100-1,000,000 or more.

In some embodiments, a GIP receptor agonist peptide, or a salt thereof is provided. The GIP receptor agonist peptide is represented by formula (I):

$P^1$-A1-A2-A3-A4-A5-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-$P^2$ (SEQ ID NO: 4), or a salt thereof;

wherein
$P^1$ represents a group represented by formula
—$R^{41}$,
—CO—$R^{41}$,
—CO—$OR^{41}$,
—CO—$COR^{41}$,
—SO—$R^{41}$,
—$SO_2$—$R^{41}$,
—$SO_2$—$OR^{41}$,
—CO—$NR^{42}R^{43}$,
—$SO_2$—$NR^{42}R^{43}$,
—C(=$NR^{41}$)—$NR^{42}R^{43}$, or
is absent, wherein $R^{41}$, $R^{42}$, and $R^{43}$ each independently represent a hydrogen atom, an optionally substituted hydrocarbon group, or an optionally substituted heterocyclic group;

$P^2$ represents —$NH_2$ or —OH;

A1 represents Tyr, 3,5-Dix Tyr, D-Tyr, 3,5 di-Br-Tyr, Phe, αMethyl-Phe, mono-halo-Phe, bis-halo-Phe, -Tyr, -D-Phe, -D-Tyr, des-amino-Phe, or des-amino-Tyr;

A2 represents Aib, Ala, Gly, Sar, Abu, or D-Ala;

A3 represents Glu or Pro;

A4 represents Gly, or Ser;

A5 represents Thr, D-Iva, Glu, Iva, or Ser;

A6 represents Ala, Aib, αMethyl-Phe, A6C, Glu, Iva, Arg, Phe, or Val;

A7 represents Ile, Lys, Val, Ala, Aib, α-methyl-Leu, A6C, Asp, Phe, Gly, Iva, Leu, Arg, or Ser:

A8 represents Ser, Ala, Aib, Asp, Phe, Gly, Leu, or Arg;

A9 represents Asp, Leu, Aib, Glu, Asn, Gln, Ser, or Phe;

A10 represents Aib, αMethyl-Phe, A6C, Lys, or Tyr;

A11 represents Aib Ser, Ala, Glu, Iva, A5c, A6c, or Leu;

A12 represents Ile, Ala, Aib, Glu, αMethyl-Phe, Phe, Lys, Arg, Ser, Trp, A6C, Cys, or Asp;

A13 represents Aib, Ala, Val, Iva, Gln, Leu, Tyr, D-Iva, αMethyl-Phe, A6C, or Glu;

A14 represents Leu, Nle, Tyr, Ala, Aib, αMethyl-Leu, Lys, Leu, Ser, Met, or Me;

A15 represents Ala, Aib, Leu, Asn, Asp, Glu, Lys, Ser, or Tyr;

A16 represents Arg Ala, Aib, Glu, Gly, Leu, Ser, or Lys;

A17 represents Aib, Ala, Lys, Asp, Arg, Gln, Glu, or Ile;

A18 represents Ala, Aib, A6C, Phe, Gly, Iva, Leu, Ser, Trp, or His;

A19 represents Gln, Ala, Val, Aib, Ile, Arg, or Ser;

A20 represents Aib, Ala, Arg, Glu, Gly, Ser, Val, or Gln;

A21 represents Asn, Asp, Glu, Leu, Ala, Aib, Lys, Gln, or Ser;

A22 represents Phe, Glu, Gln, Arg, Trp, or αMePhe;

A23 represents Ile, Aib, Asp, Glu, Arg, Thr or Val;

A24 represents Arg, Asn, Asp, Lys, Lys(Ac), Ala, Aib, Cys, Phe, Leu, Nle, Ser, Asp, or Gln;

A25 represents Trp, Aib, αMethyl-Leu, A6C, Ile, Asn, Nle, Arg, or Val;

A26 represents Aib, Iva, Ala, αMethyl-Leu, A6C, Ile, Asn, Nle, Arg, Val, or Leu;

A27 represents Leu, Val, Ala, Aib, αMethyl-Leu, A6C, Ile, Met, Nle, Arg, Trp, or Ile;

A28 represents Ala, Arg, Lys, Aib, Asp, Asn, or Lys(Ac);

A29 represents Gln, Gly, Arg, Glu, Leu, or Aib;

A30 represents Lys, Arg, Gly, or Glu;

A31 represents Pro, Gly, Hyp, Gln, Phe, ψ, or a deletion;

A32 represents Ser, Gly, Arg, Lys, ψ, or a deletion;

A33 represents Ser, Gly, Pro, Lys, ψ, or a deletion;

A34 represents Gly, Ser, Asn, ψ or a deletion;

A35 represents Ala, Ser, Ser, Asp, ψ, or a deletion;

A36 represents Pro, Gly, Gly, Hyp, Trp, ψ, or a deletion;

A37 represents Pro, Gly, Ala, Hyp, Lys, ψ, or a deletion;

A38 represents Pro, Gly, Hyp, His, ψ, or a deletion;

A39 represents Ser, Gly, Lys, Pro, Asn, ψ, or a deletion;

A40 represents Arg, Ser, Cys, Glu, Lys, Lys-Ac, Pro, Ile, ψ, or a deletion;

A41 represents Gly, Ser, Ile, Thr, ψ, or a deletion;

and wherein any one or two amino acids selected from A31 to A41 optionally represent ψ, wherein ψ is a residue independently selected from Lys, Arg, Orn, and Cys and wherein the side chain of said residue is substituted, with the proviso that the GIP receptor agonist peptide is not a peptide having an amino acid sequence of any one of SEQ ID NOs: 328-893.

In some embodiments, a GIP receptor agonist peptide, or a salt thereof is provided. The GIP receptor agonist peptide is represented by formula The GIP receptor agonist peptide according to claim 1, represented by formula (II):

P$^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-P$^2$ (SEQ ID NO: 5) or a salt thereof, wherein:

P$^1$ represents a group represented by formula
—R$^{A1}$,
—CO—R$^{A1}$,
—CO—OR$^{A1}$,
—CO—COR$^{A1}$,
—SO—R$^{A1}$,
—SO$_2$—R$^{A1}$,
—SO$_2$—OR$^{A1}$,
—CO—NR$^{A2}$R$^{A3}$,
—SO$_2$—NR$^{A2}$R$^{A3}$, or
—C(=NR$^{A1}$)—NR$^{A2}$R$^{A3}$ wherein R$^{A1}$, R$^{A2}$, and R$^{A3}$ each independently represent a hydrogen atom, an optionally substituted hydrocarbon group, or an optionally substituted heterocyclic group;

P$^2$ represents —NH$_2$ or —OH;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A17 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, or Gly;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Arg, Ser, ψ, or a deletion;
A41 represents Gly, ψ, or a deletion;
and wherein any one or two amino acids selected from A31 to A41 optionally represent ψ, wherein ψ is a residue independently selected from Lys, Arg, Orn, and Cys, and wherein the side chain of said residue is substituted, with the proviso that the GIP receptor agonist peptide is not a peptide having an amino acid sequence of any one of SEQ ID NOs: 328-893.

In some embodiments, a GIP receptor agonist peptide, or a salt thereof is provided. The GIP receptor agonist peptide is represented by formula (III):

P$^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-P$^2$ (SEQ ID NO: 6), or a salt thereof, wherein:

P$^1$ represents a group represented by formula
—R$^{A1}$,
—CO—R$^{A1}$,
—CO—OR$^{A1}$,
—CO—COR$^{A1}$,
—SO—R$^{A1}$,
—SO$_2$—R$^{A1}$,
—SO$_2$—OR$^{A1}$,
—CO—NR$^{A2}$R$^{A3}$,
—SO$_2$—NR$^{A2}$R$^{A3}$, or
—C(=NR$^{A1}$)—NR$^{A2}$R$^{A3}$ wherein R$^{A1}$, R$^{A2}$, and R$^{A3}$ each independently represent a hydrogen atom, an optionally substituted hydrocarbon group, or an optionally substituted heterocyclic group;

P$^2$ represents —NH$_2$ or —OH;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A17 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, or Gly;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Arg, Ser, ψ, or a deletion;
A41 represents Gly, ψ, or a deletion;
and wherein any one or two amino acids selected from A31 to A41 optionally represent ψ, wherein ψ is a residue independently selected from Lys, Arg, Orn, and Cys, and wherein the side chain of said residue is substituted, with the proviso that the GIP receptor agonist peptide is not a peptide having an amino acid sequence of any one of SEQ ID NOs: 328-893.

In some embodiments, a GIP receptor agonist peptide, or a salt thereof is provided. The GIP receptor agonist peptide is represented by formula (IV):

P$^1$-A1-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-P$^2$ (SEQ ID NO: 7) or a salt thereof, wherein:

P$^1$ represents a group represented by formula
—R$^{41}$,
—CO—R$^{41}$,
—CO—OR$^{41}$,
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$ wherein R$^{41}$, R$^{42}$, and R$^{43}$ each independently represent a hydrogen atom, an optionally substituted hydrocarbon group, or an optionally substituted heterocyclic group;

P$^2$ represents —NH$_2$ or —OH;
A1 represents Tyr;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A17 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Arg, Ser, ψ, or a deletion;
A41 represents Gly, ψ, or a deletion;

and wherein any one or two amino acids selected from A31 to A41 optionally represent ψ, wherein ψ is a residue independently selected from Lys, Arg, Orn, and Cys, and wherein the side chain of said residue is substituted, with the proviso that the GIP receptor agonist peptide is not a peptide having an amino acid sequence of any one of SEQ ID NOs: 328-893.

In some embodiments, a GIP receptor agonist peptide, or a salt thereof is provided. The GIP receptor agonist peptide is represented by formula (V):

wherein A1-A2-Glu-Gly-Thr-A6-A7-A8-A9-A10-A11-A12-A13-A14-A15-A16-A17-A18-A19-A20-A21-A22-A23-A24-A25-A26-A27-A28-A29 in formula (I) is Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln (SEQ ID NO: 8) or a salt thereof, with the proviso that the GIP receptor agonist peptide is not a peptide having an amino acid sequence of any one of SEQ ID NOs: 328-893.

In some embodiments, a GIP receptor agonist peptide, or a salt thereof is provided. The GIP receptor agonist peptide is represented by formula (VI):

P$^1$-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-A30-A31-A32-A33-A34-A35-A36-A37-A38-A39-A40-A41-P$^2$ (SEQ ID NO: 9) or a salt thereof, wherein
P$^1$ represents a group represented by formula
—R$^{41}$,
—CO—R$^{41}$,
—CO—OR$^{41}$,
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$ wherein R$^{41}$, R$^{42}$, and R$^{43}$ each independently represent a hydrogen atom, an optionally substituted hydrocarbon group, or an optionally substituted heterocyclic group;

P$^2$ represents —NH$_2$, or —OH;
A30 represents Arg,);
A31 represents Pro, Gly, or Lys(R);
A32 represents Ser, Gly, or Lys(R);
A33 represents Ser, Gly, or Lys(R);
A34 represents Gly, or Lys(R);
A35 represents Ala, Ser, or Lys(R);
A36 represents Pro, Gly, or Lys(R);
A37 represents Pro, Gly, Lys(R), or a deletion;
A38 represents Pro, Gly, Lys(R), or a deletion;
A39 represents Ser, Gly, Lys(R), or a deletion;
A40 represents Arg, Ser, Lys(R), or a deletion;
A41 represents Gly, Lys(R), or a deletion;

and wherein any one or two amino acids selected from A31 to A41 optionally represent Lys(R), and wherein (R) represents a substituent group, with the proviso that the GIP receptor agonist peptide is not a peptide having an amino acid sequence of any one of SEQ ID NOs: 328-893.

In some embodiments, a GIP receptor agonist peptide, or a salt thereof is provided. The GIP receptor agonist peptide is represented by formula (VII):

P$^1$-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-

Asn-Trp-Iva-Leu-Ala-Gln-A30-A31-A32-A33-A34-A35-A36-A37-A38-A39-P² (SEQ ID NO: 10), or a salt thereof, wherein:

P¹ represents a group represented by formula
—R⁴¹,
—CO—R⁴¹,
—CO—OR⁴¹,
—CO—COR⁴¹,
—SO—R⁴¹,
—SO₂—R⁴¹,
—SO₂—OR⁴¹,
—CO—NR⁴²R⁴³,
—SO₂—NR⁴²R⁴³, or
—C(=NR⁴¹)—NR⁴²R⁴³ wherein R⁴¹, R⁴², and R⁴³ each independently represent a hydrogen atom, an optionally substituted hydrocarbon group, or an optionally substituted heterocyclic group;

P² represents —NH₂, or —OH;
A30 represents Arg;
A31 represents Pro, Gly, or Lys(R);
A32 represents Ser, Gly, or Lys(R);
A33 represents Ser, Gly, or Lys(R);
A34 represents Gly, or Lys(R);
A35 represents Ala, Ser, or Lys(R);
A36 represents Pro, Gly, or Lys(R);
A37 represents Pro, Gly, Lys(R);
A38 represents Pro, Gly, Lys(R);
A39 represents Ser, Gly, Lys(R);
and wherein any one or two amino acids selected from A31 to A39 optionally represent Lys(R), and (R) represents a substituent group, or a salt thereof.

In some embodiments, a GIP receptor agonist peptide, or a salt thereof is provided. The GIP receptor agonist peptide is represented by formula (VIII):

P¹-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-A30-A31-A32-A33-A34-A35-A36-A37-A38-A39-A40-P² (SEQ ID NO: 11), or a salt thereof, wherein:

P¹ represents a group represented by formula
—R⁴¹,
—CO—R⁴¹,
—CO—OR⁴¹,
—CO—COR⁴¹,
—SO—R⁴¹,
—SO₂—R⁴¹,
—SO₂—OR⁴¹,
—CO—NR⁴²R⁴³,
—SO₂—NR⁴²R⁴³, or
—C(=NR⁴¹)—NR⁴²R⁴³ wherein R⁴¹, R⁴², and R⁴³ each independently represent a hydrogen atom, an optionally substituted hydrocarbon group, or an optionally substituted heterocyclic group;

P² represents —NH₂ or —OH;
A30 represents Arg;
A31 represents Pro, Gly, or Lys(R);
A32 represents Ser, Gly, or Lys(R);
A33 represents Ser, Gly, or Lys(R);
A34 represents Gly, or Lys(R);
A35 represents Ala, Ser, or Lys(R);
A36 represents Pro, or Lys(R);
A37 represents Pro, or Lys(R);
A38 represents Pro, or Lys(R);
A39 represents Ser, or Lys(R);
A40 represents Arg, or Ser;

and wherein any one or two amino acids selected from A31 to A39 optionally represent Lys(R), and (R) represents a substituent group, or a salt thereof.

In some embodiments, a GIP receptor agonist peptide, or a salt thereof is provided. A GIP receptor agonist peptide represented by formula (I):

P¹-A1-A2-A3-A4-A5-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-P² (SEQ ID NO: 4), or a salt thereof;

wherein
P¹ represents a group represented by formula
—R⁴¹,
—CO—R⁴¹,
—CO—OR⁴¹,
—CO—COR⁴¹,
—SO—R⁴¹,
—SO₂—R⁴¹,
—SO₂—OR⁴¹,
—CO—NR⁴²R⁴³,
—SO₂—NR⁴²R⁴³,
—C(=NR⁴¹)—NR⁴²R⁴³, or
is absent, wherein R⁴¹, R⁴², and R⁴³ each independently represent a hydrogen atom, an optionally substituted hydrocarbon group, or an optionally substituted heterocyclic group;

P² represents —NH₂ or —OH;
A1 represents Tyr, 3,5-Dix Tyr, D-Tyr, 3,5 di-Br-Tyr, Phe, αMethyl-Phe, mono-halo-Phe, bis-halo-Phe, -Tyr, -D-Phe, -D-Tyr, des-amino-Phe, or des-amino-Tyr;
A2 represents Aib, Ala, Gly, Sar, Abu, or D-Ala;
A3 represents Glu or Pro;
A4 represents Gly, or Ser;
A5 represents Thr, D-Iva, Glu, Iva, or Ser;
A6 represents Ala, Aib, αMethyl-Phe, A6C, Glu, Iva, Arg, Phe, or Val;
A7 represents Ile, Lys, Val, Ala, Aib, α-methyl-Leu, A6C, Asp, Phe, Gly, Iva, Leu, Arg, or Ser:
A8 represents Ser, Ala, Aib, Asp, Phe, Gly, Leu, or Arg;
A9 represents Asp, Leu, Aib, Glu, Asn, Gln, Ser, or Phe;
A10 represents Aib, αMethyl-Phe, A6C, Lys, or Tyr;
A11 represents Aib Ser, Ala, Glu, Iva, A5c, A6c, or Leu;
A12 represents Ile, Ala, Aib, Glu, αMethyl-Phe, Phe, Lys, Arg, Ser, Trp, A6C, Cys, or Asp;
A13 represents Aib, Ala, Val, Iva, Gln, Leu, Tyr, D-Iva, αMethyl-Phe, A6C, or Glu;
A14 represents Leu, Nle, Tyr, Ala, Aib, αMethyl-Leu, Lys, Leu, Ser, Met, or Me;
A15 represents Ala, Aib, Leu, Asn, Asp, Glu, Lys, Ser, or Tyr;
A16 represents Arg Ala, Aib, Glu, Gly, Leu, Ser, or Lys;
A17 represents Aib, Ala, Lys, Asp, Arg, Gln, Glu, or Ile;
A18 represents Ala, Aib, A6C, Phe, Gly, Iva, Leu, Ser, Trp, or His;
A19 represents Gln, Ala, Val, Aib, Ile, Arg, or Ser;
A20 represents Aib, Ala, Arg, Glu, Gly, Ser, Val, or Gln;
A21 represents Asn, Asp, Glu, Leu, Ala, Aib, Lys, Gln, or Ser;
A22 represents Phe, Glu, Gln, Arg, Trp, or αMePhe;
A23 represents Ile, Aib, Asp, Glu, Arg, Thr or Val;
A24 represents Arg, Asn, Asp, Lys, Lys(Ac), Ala, Aib, Cys, Phe, Leu, Nle, Ser, Asp, or Gln;
A25 represents Trp, Aib, αMethyl-Leu, A6C, Ile, Asn, Nle, Arg, or Val;

A26 represents Aib, Iva, Ala, αMethyl-Leu, A6C, Ile, Asn, Nle, Arg, Val, or Leu;
A27 represents Leu, Val, Ala, Aib, Methyl-Leu, A6C, Ile, Met, Nle, Arg, Trp, or Ile;
A28 represents Ala, Arg, Lys, Aib, Asp, Asn, or Lys(Ac);
A29 represents Gln, Gly, Arg, Glu, Leu, or Aib;
A30 represents Lys, Arg, Gly, or Glu;
A31 represents Pro, Gly, Hyp, Gln, Phe, ψ, or a deletion;
A32 represents Ser, Gly, Arg, Lys, ψ, or a deletion;
A33 represents Ser, Gly, Pro, Lys, ψ, or a deletion;
A34 represents Gly, Ser, Asn, ψ or a deletion;
A35 represents Ala, Ser, Ser, Asp, ψ, or a deletion;
A36 represents Pro, Gly, Gly, Hyp, Trp, ψ, or a deletion;
A37 represents Pro, Gly, Ala, Hyp, Lys, ψ, or a deletion;
A38 represents Pro, Gly, Hyp, His, ψ, or a deletion;
A39 represents Ser, Gly, Lys, Pro, Asn, ψ, or a deletion;
A40 represents Arg, Ser, Cys, Glu, Lys, Lys-Ac, Pro, Ile, ψ, or a deletion;
A41 represents Gly, Ser, Ile, Thr, ψ, or a deletion;
and wherein any one or two amino acids selected from A31 to A41 optionally represent ψ, wherein ψ is a residue independently selected from Lys, Arg, Orn, and Cys and wherein the side chain of said residue is substituted, with the proviso that the GIP receptor agonist peptide is not a peptide having an amino acid sequence of any one of SEQ ID NOs: 328-893.

In some embodiments, a GIP receptor agonist peptide, or a salt thereof is provided. The GIP receptor agonist peptide according to (1), represented by formula (II): P$^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-P$^2$ (SEQ ID NO: 5) or a salt thereof, wherein:
P$^1$ represents a group represented by formula
—R$^{41}$,
—CO—R$^{41}$,
—CO—OR$^{41}$,
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$
wherein R$^{41}$, R$^{42}$, and R$^{43}$ each independently represent a hydrogen atom, an optionally substituted hydrocarbon group, or an optionally substituted heterocyclic group;
P$^2$ represents —NH$_2$ or —OH;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A17 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, Gly, ψ, or a deletion;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Arg, Ser, ψ, or a deletion;
A41 represents Gly, ψ, or a deletion;
and wherein any one or two amino acids selected from A31 to A41 optionally represent ψ, wherein ψ is a residue independently selected from Lys, Arg, Orn, and Cys, and wherein the side chain of said residue is substituted, with the proviso that the GIP receptor agonist peptide is not a peptide having an amino acid sequence of any one of SEQ ID NOs: 328-893.

In various embodiments, an illustrative GIP receptor agonist peptide for use in the methods, compositions and medicaments exemplified herein, has at least 80%, or at least 85%, or at least 90%, or at least 95%, or at least 96%, or at least 97%, or at least 98%, or at least 99%, or 100% sequence identity to any GIP receptor agonist peptide as defined by formulas (I), (II), (III), (IV), (V), (VI), (VII), and (VIII).

In various embodiments, an illustrative GIP receptor agonist peptide for use in the methods, compositions and medicaments exemplified herein, has 100% sequence identity to any GIP receptor agonist peptide as defined by formulas (I), (II), (III), (IV), (V), (VI), (VII), and (VIII).

In various embodiments, the GIP receptor agonist peptide as defined by formulas (I), (II), (III), (IV), (V), (VI), (VII), and (VIII) has a P$^2$ defined by a methyl (Me) group.

With reference to the above GIP receptor agonist peptides as defined by formulas (I), (II), and (III), in various embodiments, a GIP receptor agonist peptide has at least one, two or three amino acids having a bivalent substituent, covalently coupled to a side chain of an amino acid. For example, in some embodiments, a GIP receptor agonist peptide has an amino acid sequence having a side chain of at least one amino acid, or modified amino acid for example, a Cys, homocystein, Lys, Orn, Dab, Dap, or p-amine-phenylalanine residue of the GIP receptor agonist peptide being covalently attached to a substituent group (R). In various embodiments, a Cys, homocystein, Lys, Orn, Dab, Dap, or p-amine-phenylalanine residue herein after exemplified as "ψ" of the GIP receptor agonist peptide may be covalently attached to a substituent (R).

In some embodiments, ψ is a residue independently selected from Lys, Arg, Orn, and Cys, and having a substituted side chain. For example, a selective GIP receptor agonist peptide may have a ψ residue substituted by and (R) group. In various embodiments, the (R) group represents X-L-, wherein L represents a bivalent linker. In some embodiments, the bivalent linker can include a PEG, Abu-, (Gly)(2-8)-, gGlu(1-3)-, one to ten amino acids, for example, a glycine linker having two to ten glycine residues, two to six or from five to six glycines linked, or combinations of the foregoing linkers. In these embodiments, X represents a substituent group.

In various embodiments, the GIP receptor agonist peptide may include one or two ψ residues, for example, one or two residues from the following examples, Cys, homocystein, Lys, Orn, Dab, Dap, or p-amine-phenylalanine is substituted with an X-L-substituent. In some embodiments, ψ is a Lys residue and/or or a Cys residue each independently having a side chain substituted with X-L-. In various embodiments, the GIP receptor agonist peptide may include one or two ψ residues, for example, one or two residues from the following examples, Cys, homocystein, Lys, Orn, Dab, Dap, or p-amine-phenylalanine is substituted with an X-L-substituent, wherein L represents (PEG3)$_2$-, Abu-, (Gly)(2-8)-(GG, GGG, or any one of SEQ ID NOs: 283, 284, 285, 286, 287), gGlu(1-3)-, or combinations thereof, for example, (PEG3)$_2$-gGlu-, Abu-gGlu-, (Gly)$_5$-gGlu-(SEQ ID NO: 289), or (Gly)$_6$-gGlu-(SEQ ID NO: 290), GGGGG-(SEQ ID NO: 284), (PEG3)$_2$-, (PEG3)$_2$-(Gly)$_{5-6}$ (SEQ ID NOs: 291, 292), or combinations thereof.

In some embodiments, the GIP receptor agonist peptide has one, or two, or three ψ residues independently selected from Lys, Arg, Orn, and Cys, wherein each ψ residue independently has a substituted side chain. For example, a selective GIP agonist peptide may have a ψ residue substituted by X-L-, wherein L represents a bivalent linker, as discussed herein, for example, L may represent a bond or a bivalent substituent group, and wherein X represents an optionally substituted hydrocarbon group, or a salt thereof. In some embodiments, the bivalent substituent group comprises: an alkylene group, a carbonyl group, an oxycarbonyl group, an imino group, an alkylimino group, a sulfonyl group, an oxy group, a sulfide group, an ester bond, an amide bond, a carbonate bond or combinations thereof.

In various embodiments, the GIP receptor agonist peptide may include one, or two, or three ψ residues, for example, one or two residues from the following examples, Cys, homocystein, Lys, Orn, Dab, Dap, or p-amine-phenylalanine, wherein each ψ residue may be substituted with an (R) group defined as an X-L-substituent. In some embodiments, ψ is a Lys residue and/or or a Cys residue each independently having a side chain substituted with X-L-. In related embodiments, the GIP receptor agonist peptide the X moiety can be an optionally substituted hydrocarbon. In some embodiments, the X moiety in the X-L-substituent can include a $C_6$-$C_{20}$ monacid, a $C_6$-$C_{20}$ diacid, an acetyl group, or combinations thereof.

Some exemplary X moieties may include: (Trda:C13 diacid), (Teda:C14 diacid), (Peda:C15 diacid), (Heda:C16 diacid), (Hepda:C17 diacid), (Oda:C18 diacid), or (Eda:C20 diacid) (Ida:C_diacid).

In various embodiments, a GIP receptor agonist peptide of formulas (IV)-(VIII) may have one, two or three Lys amino acids each substituted with an (R) group. In some embodiments, at least one Lys amino acid, for example, one Lys, two Lys or three Lys residues from amino acid residues 30-41 and 46 in the GIP receptor agonist peptide may be substituted with an (R) group designated as "Lys(R)". In various embodiments, an (R) group is also defined as X-L- as discussed above with reference to a ψ residue above related to GIP receptor agonist peptides of formulas (I) to (III). In some embodiments, the L moiety of the X-L- group can include, a bivalent linker. In some examples, the bivalent linker can include PEG, Abu-, (Gly)$_{(2-8)}$-, gGlu$_{(1-3)}$-, one to ten amino acids, or combinations thereof. In these examples of X-L, X may represents a substituent group.

In some embodiments, (R) represents X-L- wherein L represents (PEG3)2-, Abu-, (Gly)$_{(2-8)}$ (GG, GGG, or any one of SEQ ID NOS: 283, 284, 285, 286, 287), gGlu$_{(1-3)}$-, or combinations thereof. In some embodiments, L represents (PEG3)2-gGlu-, Abu-gGlu-, (Gly)$_5$-gGlu (SEQ ID NO: 289), (Gly)$_6$-gGlu-(SEQ ID NO: 290), GGGGG-(SEQ ID NO: 284), GGGGGG-(SEQ ID NO: 285), (PEG3)2-, or (PEG3)2-(Gly)$_{5-6}$-(SEQ ID NOs: 291, 292).

In some related embodiments, L represents a bond or a bivalent substituent group, and X represents an optionally substituted hydrocarbon group, or a salt thereof. For example, an illustrative GIP receptor agonist peptide has an (R) group wherein X is a bivalent substituent group comprising an alkylene group, a carbonyl group, an oxycarbonyl group, an imino group, an alkylimino group, a sulfonyl group, an oxy group, a sulfide group, an ester bond, an amide bond, a carbonate bond or combinations thereof.

In some embodiments, an illustrative Lys(R) can include an (R) group defined as X-L- group, wherein the bivalent substituent X is a $C_6$-$C_{20}$ monacid, a $C_6$-$C_{20}$ diacid or an acetyl group. Some exemplary X moieties may include: (Trda:C13 diacid), (Teda:C14 diacid), (Peda:C15 diacid), (Heda:C16 diacid), (Hepda:C17 diacid), (Oda:C18 diacid), or (Eda:C20 diacid) (Ida:C_diacid).

In some embodiments, an illustrative GIP receptor agonist peptide of formulas (I), (II), (III), (IV), (V), (VI), (VII), and (VIII), can include a peptide having one, to or three amino acids selected from A31 to A41, wherein the ψ residue or Lys(R) residue has a substituted side chain defined by X-L-. In exemplary embodiments, the X-L- group of the ψ residue or Lys(R) residue may include: -(g-Glu)$_2$-Oda, -(g-Glu)$_2$-Eda, -(g-Glu)$_2$-Heda, -(PEG3)2-gGlu-Eda, -(PEG3)2-gGlu-Heda, -(PEG3)2-gGlu-Oda, -(PEG3)2-gGlu-Ida, -(PEG3)-gGlu-Eda, -(PEG3)-gGlu-Heda, -(PEG3)-gGlu-Oda, -Abu-gGlu-Oda, -(Gly)$_5$-gGlu-Eda (SEQ ID NO: 293), -(Gly)$_5$-gGlu-Heda (SEQ ID NO: 294), -(Gly)$_5$-gGlu-Oda (SEQ ID NO: 295), -(Gly)$_5$-Heda (SEQ ID NO: 296), -(Gly)$_5$-Oda (SEQ ID NO: 297), -(Gly)$_5$-Eda (SEQ ID NO: 298), -(PEG3)2-Heda, -(PEG3)2-Eda, -(PEG3)2-Oda, or combinations thereof.

In various embodiments, a Cys, homocystein, Lys, Orn, Dab, Dap, or p-amine-phenylalanine residue of the GIP receptor agonist peptide may be covalently attached to a substituent, for example a bivalent substituent. In some embodiments, a Cys, homocystein, Lys, Orn, Dab, Dap, or p-amine-phenylalanine residue of the GIP receptor agonist peptide may be covalently attached to an (R) group. In some illustrative examples, the (R) group may be covalently linked to a side chain of a Lys amino acid. In some examples, an exemplary (R) group represents X-L-, wherein L represents a bivalent linker comprising PEG and/or two or more amino acids, and X represents a substituent group, or a salt thereof.

In various embodiments, the GIP receptor agonist peptide of formulas (I)-(VIII) or a salt thereof, has one or two Lys(R), residues located at a position between A31 to A41, wherein (R) represents a substituent group, with the proviso that the GIP receptor agonist peptide is not a peptide with an amino acid sequence of any one of SEQ ID NOs: 328-893.

More preferably, R represents X-L-, wherein L is one or a combination of more than one selected from a glycine linker comprising one or two to nine-linked glycine(s) or a single bond, and X represents $C_6$-$C_{20}$ monacid or diacid, or an acetyl group.

In embodiments, R represents X-L-, wherein X-L- preferably represents Trda-GGGG (SEQ ID NO: 299), -(Trda:C13 diacid), Trda-GGGGG-(SEQ ID NO: 300), Trda-GGGGGG-(SEQ ID NO: 301), -, Teda-GGGG (SEQ ID NO: 302), -(Teda:C14 diacid), Teda-GGGGG (SEQ ID NO: 303), Teda-GGGGGG (SEQ ID NO: 304), Peda-GGGG (SEQ ID NO: 305), (Peda:C15 diacid), Peda-GGGGG (SEQ ID NO: 306), Peda-GGGGGG (SEQ ID NO: 307), Heda-GGGG (SEQ ID NO: 308), (Heda:C16 diacid), Heda-GGGGG (SEQ ID NO: 309), Heda-GGGGGG-(SEQ ID NO: 310), Hepda-GGGG-(SEQ ID NO: 311), -(Hepda:C17 diacid), Hepda-GGGGG-(SEQ ID NO: 312), Hepda-GGGGGG (SEQ ID NO: 313), Oda-GGGG-(SEQ ID NO:314), -(Oda:C18 diacid), Oda-GGGGG-(SEQ ID NO: 315), Oda-GGGGGG (SEQ ID NO: 316), Eda-GGGG (SEQ ID NO: 317), -(Eda:C20 diacid), Eda-GGGGG-(SEQ ID NO: 318), Eda-GGGGGG-(SEQ ID NO: 319), Eda-GGGGGGGGG- (SEQ ID NO: 320).

Alternatively, in some embodiments, (R) represents X-L-, wherein L represents a glycine linker comprising four, five or six-linked glycines, and X represents C16-C20 linear saturated dicarboxylic acid.

In various embodiments, in each of the examples of GIP receptor agonist peptides of formulas (I) to (VIII), at least one amino acid between A31 to A41, or from A30 to A40, or from A30 to A39 is Lys(R), wherein (R) represents X-L-, wherein L represents a bivalent linker L, wherein L represents (PEG3)2-, Abu-, $(Gly)_{(2\text{-}10)}$-(GG, GGG, or any of SEQ ID NOs: 283, 284, 285, 286, 287, 288, or 321), $gGlu_{(1\text{-}3)}$-, or combinations thereof. In some embodiments, L represents (PEG3)2-gGlu-. In some examples, L represents Abu-gGlu-. In other examples, L represents $(Gly)_5$-gGlu-(SEQ ID NO: 289), or $(Gly)_6$-gGlu-(SEQ ID NO: 290). In some embodiments, L represents a glycine peptide having from about two to about ten glycines linked (GG, GGG, or any of SEQ ID NOs: 283, 284, 285, 286, 287, 288, or 321), or from about two to about seven glycines linked (GG, GGG, or any of SEQ ID NOs: 283, 284, 285, or 286). In some examples, L represents $(Gly)_{5\text{-}6}$- (SEQ ID NO: 284)-(SEQ ID NO: 285), or $(Gly)_5$- (SEQ ID NO: 284), GGGGG-(SEQ ID NO: 284), or GGGGG-gGlu-(SEQ ID NO: 289). In some embodiments, L represents (PEG3)2-. In some embodiments, L represents $(Gly)_{2\text{-}10}$- (GG, GGG, or any of SEQ ID NOs: 283, 284, 285, 286, 287, 288, or 321), for example, $(Gly)_{(5\text{-}6)}$ (SEQ ID NO: 284, 285). In some further embodiments, L represents a combination of groups, such as one or more PEG molecules linked to a glycine peptide: $Gly_{2\text{-}10}$ (GG, GGG, or any of SEQ ID NOs: 283, 284, 285, 286, 287, 288, or 321) for example, L may be (PEG3)2-$(Gly)_{5\text{-}6}$-(SEQ ID NO: 291, 292), or (PEG3)2-$(Gly)_5$- (SEQ ID NO: 291). In some related embodiments, (R) represents X-L-, wherein L represents a bond or a bivalent substituent group, and X represents an optionally substituted hydrocarbon group, or a salt thereof. In various embodiments related to the various L moiety exemplifications, (R) represents X-L, wherein L is discussed above and X is a $C_6$-$C_{20}$ monacid, a $C_6$-$C_{20}$ diacid or an acetyl group. For example, in some embodiments, X is (Trda:C13 diacid), (Teda:C14 diacid), (Peda:C15 diacid), (Heda:C16 diacid), (Hepda:C17 diacid), (Oda:C18 diacid), (Eda:C20 diacid) or (Ida:C_diacid).

In some embodiments, (R) represents X-L-, wherein L represents a bivalent linker comprising PEG and/or amino acid or consisting of PEG and/or one or more amino acids, for example, $Gly_{2\text{-}10}$- (GG, GGG, or any of SEQ ID NOs: 283, 284, 285, 286, 287, 288, or 321) linker, and X represents a substituent group. A known PEG linker, an amino acid linker or combinations thereof may be used as illustrative examples of a bivalent linker, as long as it is able to link Lys to a substituent group. Alternatively, in some embodiments, R represents X-L-, wherein L represents a bond or a bivalent substituent group, and X represents an optionally substituted hydrocarbon group, or a salt thereof. A known bivalent substituent group may include, but is not limited to, an alkylene group, a carbonyl group, an oxycarbonyl group, an imino group, an alkylimino group, a sulfonyl group, an oxy group, a sulfide group, an ester bond, an amide bond, a carbonate bond or combinations thereof may be used.

In some embodiments, L represents (PEG3)2-, Abu-, $(Gly)_{(2\text{-}10)}$- (GG, GGG, or any of SEQ ID NOs: 283, 284, 285, 286, 287, 288, or 321), $gGlu_{(1\text{-}3)}$-, or combinations thereof. In some embodiments, L represents (PEG3)2-gGlu-. In some examples, L represents Abu-gGlu-. In other examples, L represents $(Gly)_5$-gGlu- (SEQ ID NO: 289), or $(Gly)_6$-gGlu- (SEQ ID NO: 290). In some embodiments, L represents a glycine peptide having from about two to about ten glycines linked, or from about two to about seven glycines linked. In some examples, L represents $(Gly)_{5\text{-}6}$- (SEQ ID NO: 284, 285), or $(Gly)_5$-(SEQ ID NO: 284), GGGGG-(SEQ ID NO: 284), or GGGGG-gGlu-(SEQ ID NO: 289).

In some embodiments, L represents (PEG3)2-. In some embodiments, L represents $(Gly)_{2\text{-}10}$-(GG, GGG, or any of SEQ ID NOs: 283, 284, 285, 286, 287, 288, or 321), for example, $(Gly)_{(5\text{-}6)}$ (SEQ ID NO: 284, 285). In some further embodiments, L represents a combination of groups, such as one or more PEG molecules linked to a glycine peptide: $(Gly)_{2\text{-}10}$ (GG, GGG, or any of SEQ ID NOs: 283, 284, 285, 286, 287, 288, or 321) for example, L may be (PEG3)2-$(Gly)_{5\text{-}6}$-(SEQ ID NO: 291, 292), or (PEG3)2-$(Gly)_5$ (SEQ ID NO: 291).

In some embodiments, the (R) group attached to an amino acid, for example, a Cys, homocystein, Lys, Orn, Dab, Dap, or p-amine-phenylalanine residue represents X-L-, wherein L represents a bivalent linker comprising PEG and/or one or more amino acids or consisting of PEG and/or one or more amino acids, and X represents a substituent group. A known PEG linker, an amino acid linker or combinations thereof may be used as the bivalent linker as long as it is able to link, a Cys, homocystein, Lys, Orn, Dab, Dap, or p-amine-phenylalanine residue to a substituent group. Alternatively, preferably, R represents X-L-, wherein L represents a bond or a bivalent substituent group, and X represents an optionally substituted hydrocarbon group, or a salt thereof. A known bivalent substituent group including, but are not limited to, an alkylene group, a carbonyl group, an oxycarbonyl group, an imino group, an alkylimino group, a sulfonyl group, an oxy group, a sulfide group, an ester bond, an amide bond, a carbonate bond or combinations thereof may be used. More preferably, (R) represents X-L-, wherein L is one or a combination of more than one selected from:

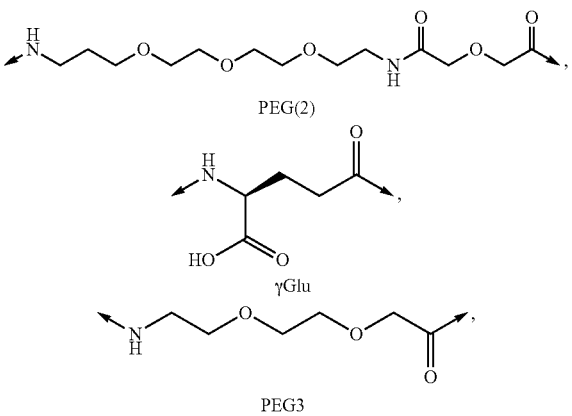

PEG(2)

γGlu

PEG3

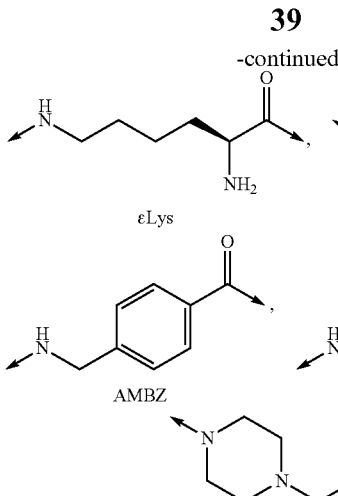

εLys, GABA, AMBZ, Tra

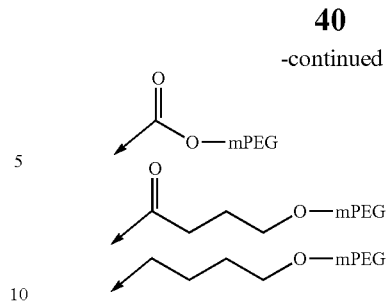

In some embodiments, exemplary MPEG linkers which may be used for coupling a substituent X to a Cys amino acid can include a MPEG molecule having an weight average molecular weight of about 5-30 kDa. In some embodiments, illustrative PEG linkers for attachment to a Cys side chain can include:

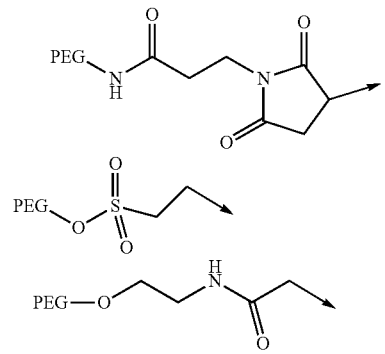

In various examples, R represents X-L-, wherein X-L- preferably represents Trda-GGGG (SEQ ID NO: 299), -(Trda:C13 diacid), Trda-GGGGG (SEQ ID NO: 300), Trda-GGGGGG-(SEQ ID NO: 301), Teda-GGGG-(SEQ ID NO: 302) (Teda:C14 diacid), Teda-GGGGG (SEQ ID NO: 303)-, Teda-GGGGGG (SEQ ID NO: 304)-, Peda-GGGG-(SEQ ID NO: 305) (Peda:C15 diacid), Peda-GGGGG (SEQ ID NO: 306)-Peda-GGGGGG-(SEQ ID NO: 307), Heda-GGGG-(SEQ ID NO: 308) (Heda:C16 diacid), Heda-GGGGG-(SEQ ID NO: 309), Heda-GGGGGG-(SEQ ID NO: 310), Hepda-GGGG-(SEQ ID NO: 311) (Hepda:C17 diacid), Hepda-GGGGG-(SEQ ID NO: 312), Hepda-GGGGGG-(SEQ ID NO: 313), Oda-GGGG (SEQ ID NO:314), (Oda:C18 diacid), Oda-GGGGG-(SEQ ID NO: 315), Oda-GGGGGG-(SEQ ID NO: 316), Eda-GGGG-(SEQ ID NO: 317) (Eda:C20 diacid), Eda-GGGGG-(SEQ ID NO: 318), Eda-GGGGGG-(SEQ ID NO: 319), Eda-GGGGGGGGG-(SEQ ID NO: 320).

Alternatively, particularly preferably, the (R) group represents X-L-, wherein L represents a glycine linker comprising five or six-linked glycines, and X represents $C_{16}$-$C_{20}$ linear saturated dicarboxylic acid.

Alternatively, particularly preferably, the (R) group represents X-L-, wherein L represents a bond or a bivalent substituent group, and X represents an a C12-C20 fatty acid, or a C12-C20 acylated fatty acid or a salt thereof. In some embodiments, the X represents a palmitic fatty acid used to add a palmitoyl group to the epsilon amine side group of a Cys, homocystein, Lys, Orn, Dab, Dap, or p-amine-phenylalanine residue, for example, a Lys reside in the GIP receptor agonist peptide.

In other embodiments, the GIP receptor agonist peptide has one, or two or three modified lysine residues, i.e. Lys(R), a glycine linker comprising one or two to nine-linked glycine(s) or a single bond, and X represents $C_6$-$C_{20}$ monacid or diacid, or an acetyl group. In some embodiments, a linker L, can be coupled or linked covalently to a side chain of at least one amino acid, or modified amino acid for example, a Cys, homocystein, Lys, Orn, Dab, Dap, or p-amine-phenylalanine residue of the GIP receptor agonist peptide being covalently attached to a substituent group. In an embodiment, the selective GIP receptor agonist peptide is covalently attached to an (R) group, wherein the (R) group is a hydrophilic polymer at any amino acid position from A16 to the C-terminus. In an embodiment, the selective GIP receptor agonist peptide is covalently attached to a hydrophilic polymer at amino acid position A31 to A41. For example, the hydrophilic polymer may be attached to the side chain of Cys, homocystein, Lys, Orn, Dab, Dap, or p-amine-phenylalanine of the selective GIP receptor agonist peptide. In an embodiment, the hydrophilic polymer is a polyethylene glycol (PEG). For example, the PEG has a molecular weight of about 1,000 Daltons to about 40,000 Daltons, such as about 5,000 Daltons to about 40,000 Daltons, preferably about 1,000 Daltons, or 5,000 Daltons, or 10,000 Daltons, or 12,000 Daltons, or 14,000 Daltons to about 20,000 Daltons.

In some embodiments, the linker L is a PEG molecule, for example, PEG3(n), PEG(2)(n), or mPEG having a weight average molecular weight of about 5-30 kDa. In some embodiments, L can be any combination of PEG3(n), PEG(2)(n), gGlu(n), D-gGlu(n), AMBZ(n), GABA(n), G(x), NpipAc(n), Tra(n), eLya(n), where n=1-5 and x=1-10. Exemplary PEG linkers can be used as part of an (R) group in a substituted ψ residue, for example, a Cys, homocystein, Lys, Orn, Dab, Dap, or p-amine-phenylalanine residue, for example, located at one or more of A30-A41, for example, A30-A40, or A30 to A39, wherein the MPEG linker can include one or more of the following additional MPEG linkers:

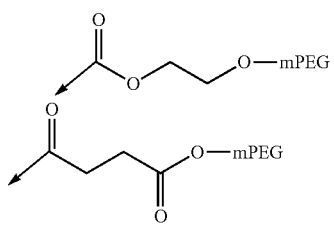

wherein the (R) group represents X-L-, wherein L represents a glycine linker comprising three, four, five or six-linked glycines, and X represents $C_6$-$C_{20}$ linear saturated dicarboxylic acid. In an embodiment, the acyl group is a C6 to C20 fatty acyl group, for example a palmitoyl or myristoyl fatty acyl group.

In an embodiment, the GIP receptor agonist peptide is covalently attached to an (R) group, wherein the (R) group is a hydrophilic polymer at any amino acid position from A30 to the C-terminus. In an embodiment, the GIP receptor agonist peptide is covalently attached to a hydrophilic polymer at amino acid position, A31, A32, A30, A33, A34, A35, A36, A37, A38, A39, A40, A41, or combinations thereof, for example, at positions A31-A41 or from A31 to A39. For example, the hydrophilic polymer may be attached to the side chain of a Cys, homocystein, Lys, Orn, Dab, Dap, or p-amine-phenylalanine of the GIP receptor agonist peptide. In an embodiment, the hydrophilic polymer is a polyethylene glycol (mPEG). The mPEG polymer may also be further conjugated to a glycine linker, i.e. $(Gly)_{(2-8)}$-, or to one or more gGlu-residues, for example, $gGlu_{(1-3)}$-. In some examples, the mPEG has a weight average molecular weight of about 1,000 Daltons to about 60,000 Daltons, such as about 5,000 Daltons to about 40,000 Daltons, preferably about 1,000 Daltons, or 5,000 Daltons or 10,000 Daltons, or 12,000 Daltons, or 14,000 Daltons to about 20,000 Daltons.

In some embodiments, methods for conjugating a polyethylene glycol (mPEG) polymer to a reactive amine or sulfhydryl group is well known in the art. For example, mPEG can be conjugated to a lysine amine sidechain using an amine-reactive pegylated crosslinker. A Bis(succinimidyl)penta(ethylene glycol) spacer arm can be used as a homobifunctional, amine-to-amine crosslinker that contain N-hydroxy-succinimide (NHS) esters at both ends of a mPEG spacer arm. An amine-reactive crosslinker that contains a PEG spacer arm. A bis-succinimide ester-activated mPEG compound may be used for crosslinking between primary amines (—$NH_2$) in GIP receptor agonist peptides of the present disclosure. The N-hydroxysuccinimide ester (NHS) groups at either end of the mPEG spacer react specifically and efficiently with lysine and N-terminal amino groups at pH 7-9 to form stable amide bonds. Other homobifunctional, sulfhydryl-reactive crosslinkers that contain the maleimide group at either end of a PEG spacer may be used to couple PEG to a Cys amino acid of a GIP receptor agonist peptide. Heterofunctional crosslinking spacer arms may also be used when two different reactive groups are used as the linkage groups, e.g. an amine group and a sulfhydryl group. A sulfhydryl-reactive crosslinker that contains a PEG spacer arm, may be used to couple a PEG polymer to a GIP receptor agonist peptide. In some embodiments, a bismaleimide-activated PEG compound may be used for crosslinking between sulfhydryl (—SH) groups in proteins and other thiol molecules. The maleimide groups at either end of the PEG spacer may react specifically and efficiently with reduced sulfhydryls at pH 6.5-7.5 to form stable thioether bonds. In other embodiments, direct coupling of a PEG molecule to a GIP receptor agonist peptide may be accomplished using known methods in the art. For example, a well known technique whereby a peptide may be covalently modified with PEG groups requiring PEG compounds that contain a reactive or targetable functional group at one end. The simplest method to pegylate peptides, which are rich in surface primary amines, is to use a PEG compound that contains an NHS ester group at one end, for example, a methyl-(PEG)n-NHS ester. In a similar fashion, methyl-(PEG)n-maleimide (wherein n can be from 20-300) may be used to couple a PEG molecule to a Cys containing peptide of the present disclosure. Methods known in the art for conjugation of polyethylene glycol polymers of various lengths ranging from 1,000 Daltons to 20,000 Daltons or more are provided in 1. Hermanson, G. T. (2013). 3rd Edition. Bioconjugate Techniques, Academic Press, Veronese, F. and Harris, J. M. Eds. (2002). Peptide and protein PEGylation. Advanced Drug Delivery Review 54(4), 453-609, Zalipsky, S., et al., "Use of Functionalized Poly (Ethylene Glycols) for Modification of Polypeptides" in Polyethylene Glycol Chemistry: Biotechnical and Biomedical Applications, J. M. Harris, Plenus Press, New York (1992), and in Zalipsky (1995) Advanced Drug Reviews 16:157-182 the disclosures of all of these references are hereby incorporated by reference herein in their entireties.

In various embodiments, the GIP receptor agonist peptide disclosed herein, for example, as used in the preparation of a medicament, a composition, or for use in the prevention and/or treatment of a condition, or disorder, or in a method of prevention and/or treatment as disclosed herein, as represented by a GIP receptor agonist peptide has an amino acid sequence as provided in any one of formulas (I), (II), (III), (IV), (V), (VI), (VII), and (VIII), with the proviso, that the GIP receptor agonist peptide having an amino acid sequence of any one of formulas (I), (II), (III), (IV), (V), (VI), (VII), and (VIII), does not have an amino acid sequence as disclosed in any peptide having an amino acid sequence of SEQ ID NOs: 328-893.

Figure 1A:
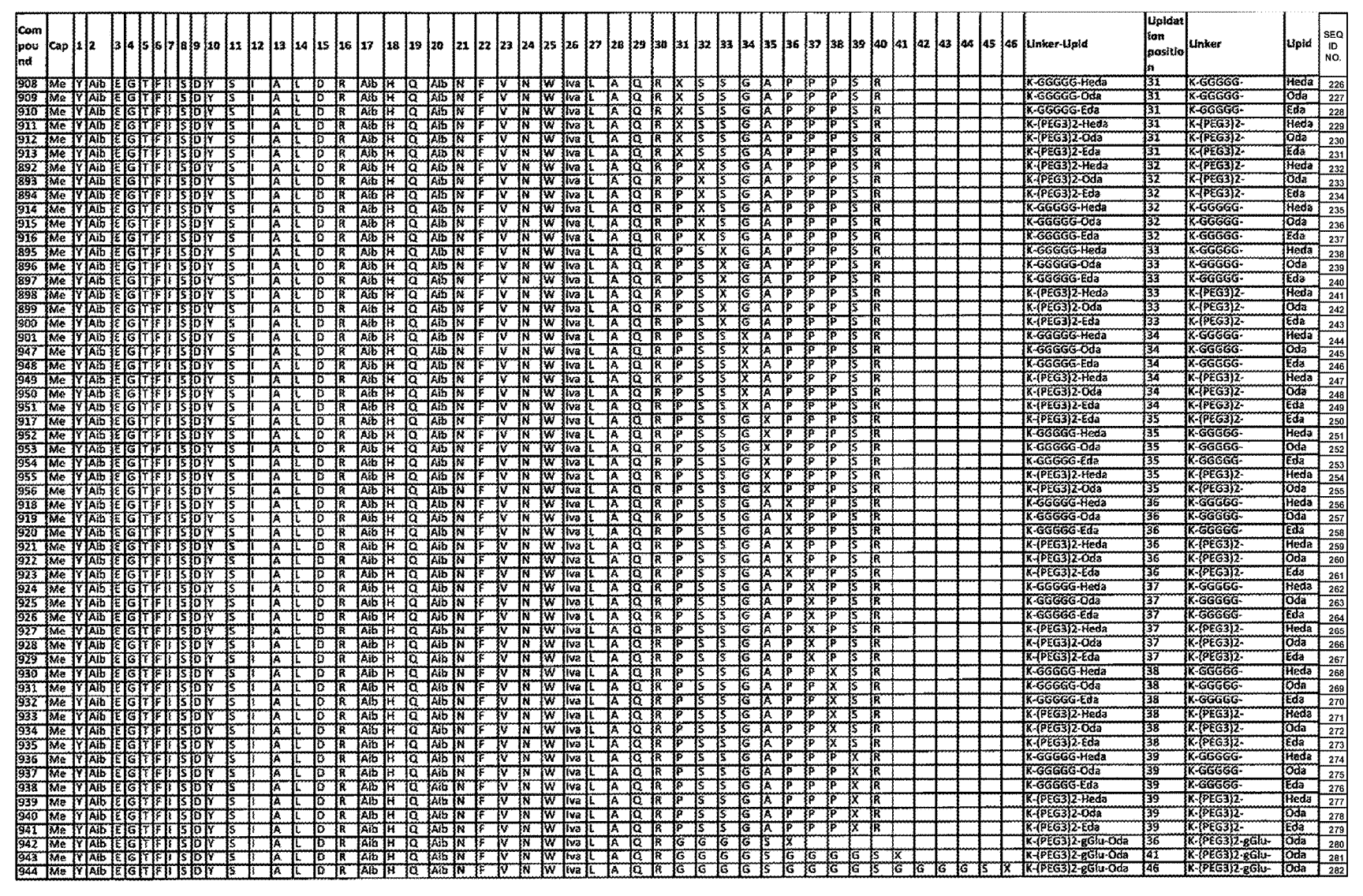
Figure 1B:
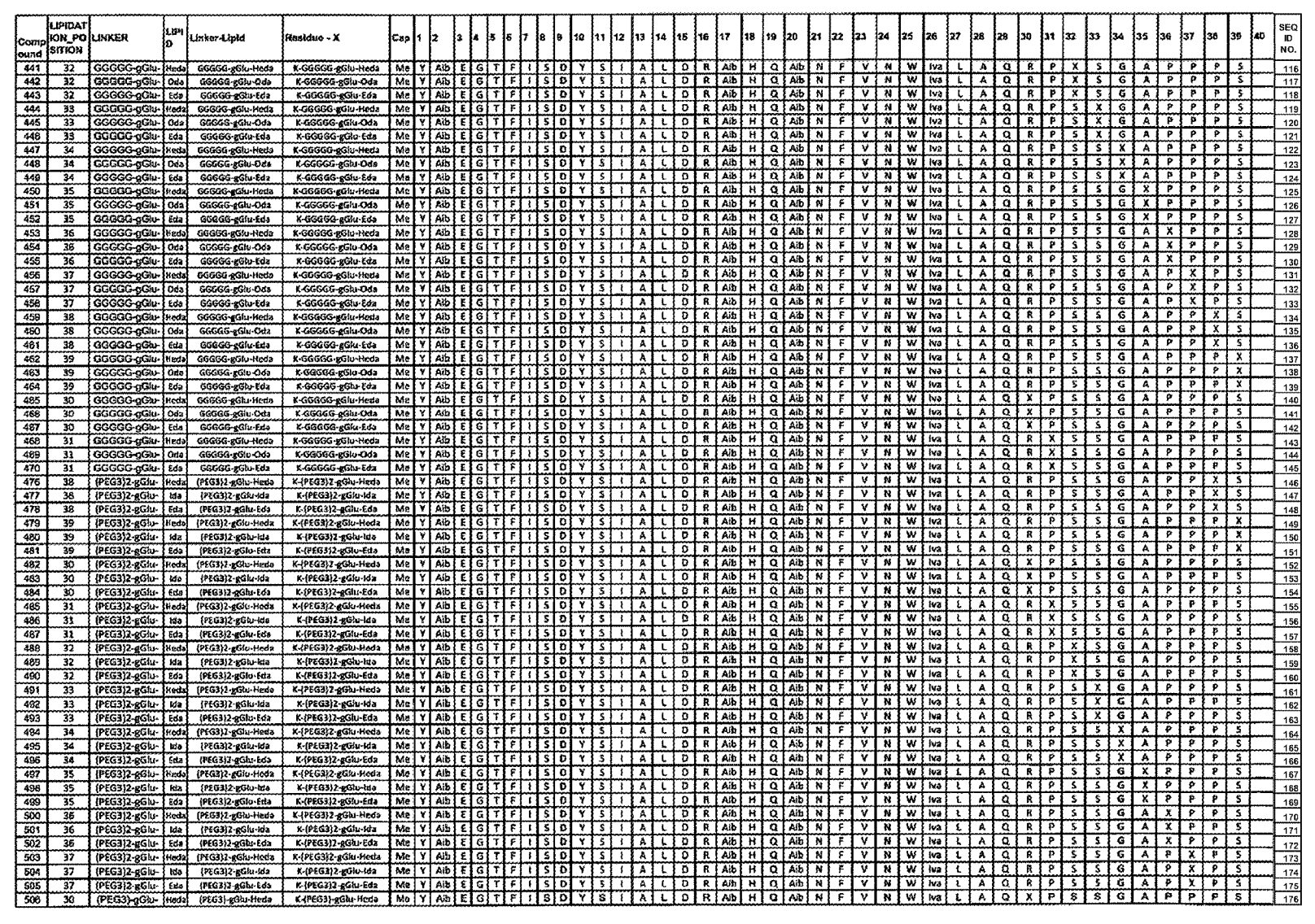
Figure 1D:
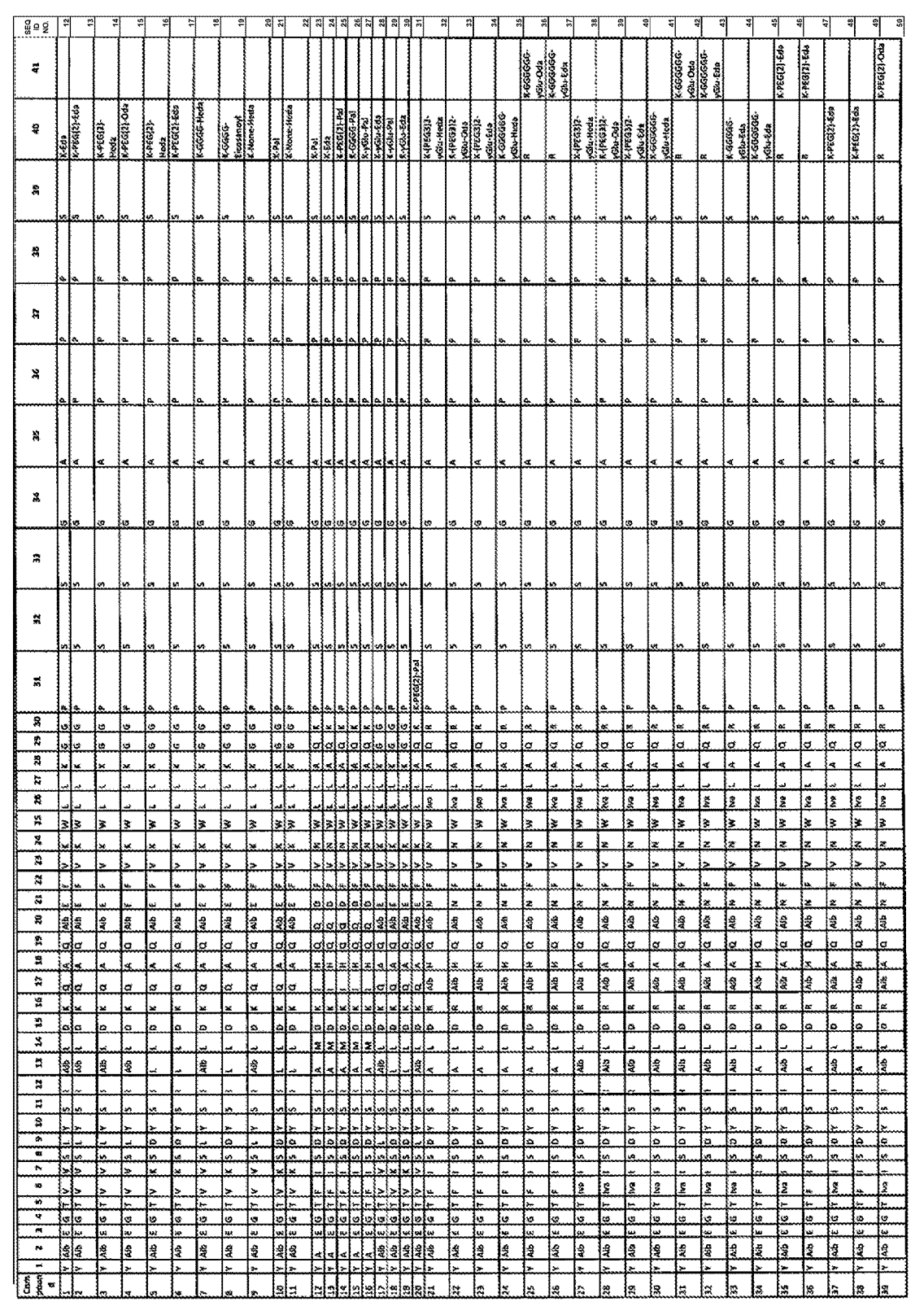
Figure 1E:
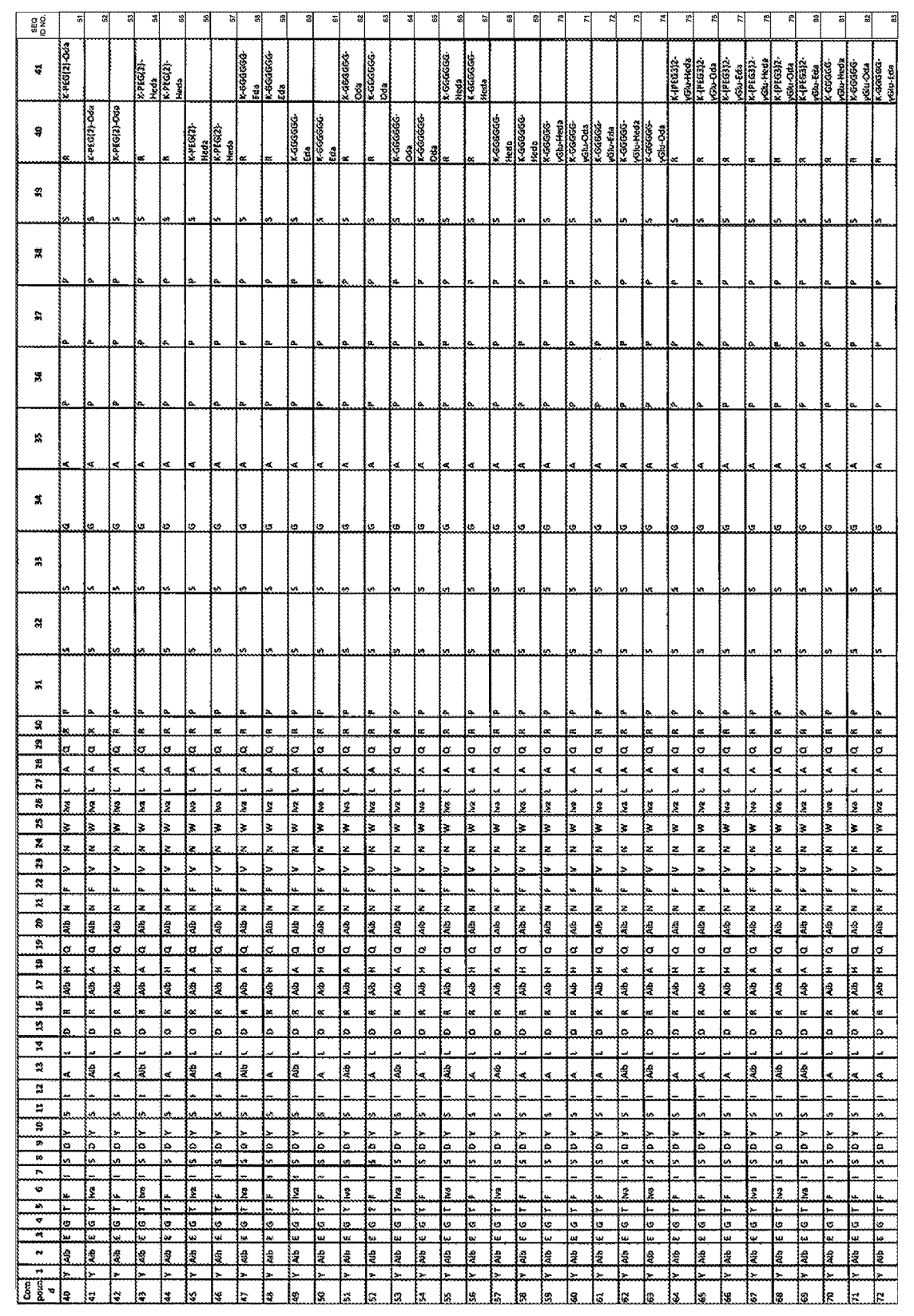
Figure 1F:
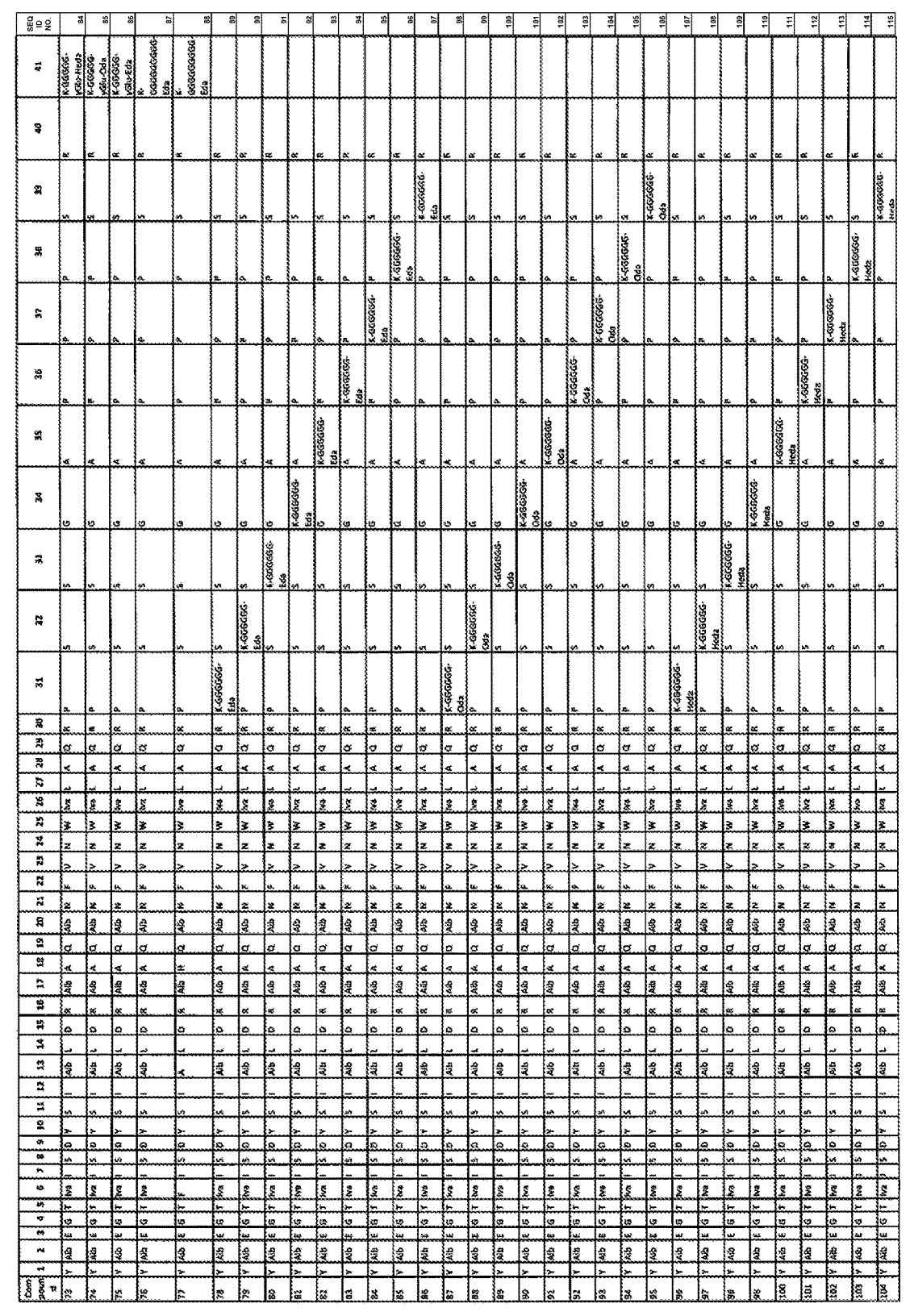

In various embodiments, exemplary GIP receptor agonist peptides having a structure as defined in any one of formulas (I), (II), (III), (IV), (V), (VI), (VII), and (VIII), are provided in FIG. 1.

B. SYNTHESIS GIP AGONIST PEPTIDES

The GIP receptor agonist peptide may be synthesized recombinantly or can be produced according to a peptide synthesis method known in the art. The peptide synthesis method may be any of, for example, a solid phase synthesis process and a liquid phase synthesis process. That is, the object GIP receptor agonist peptide can be produced by repeating condensation of a partial peptide or amino acid capable of constituting the GIP receptor agonist peptide, and the remaining portion (which may be constituted by two or more amino acids) according to a desired sequence. When a product having the desirable sequence has a protecting group, the object GIP receptor agonist peptide can be produced by eliminating a protecting group. Examples of the condensing method and eliminating method of a protecting group to be known include methods described in the following (1)-(5).

(1) M. Bodanszky and M. A. Ondetti: Peptide synthesis, Interscience Publishers, New York (1966)
(2) Schroeder and Luebke: The Peptide, Academic Press, New York (1965)
(3) Nobuo Izumiya, et al.: Peptide Gosei-no-Kiso to Jikken (Basics and experiments of peptide synthesis), published by Maruzen Co. (1975)
(4) Haruaki Yajima and Shunpei Sakakibara: Seikagaku Jikken Koza (Biochemical Experiment) 1, Tanpakushitsu no Kagaku (Chemistry of Proteins) IV, 205 (1977)
(5) Haruaki Yajima, ed.: Zoku Iyakuhin no Kaihatsu (A sequel to Development of Pharmaceuticals), Vol. 14, peptide synthesis, published by Hirokawa Shoten.

After the reaction, the GIP receptor agonist peptide can be purified and isolated using conventional methods of purification, such as solvent extraction, distillation, column chromatography, liquid chromatography, recrystallization, etc., in combination thereof. When the peptide obtained by the above-mentioned method is in a free form, it can be converted to a suitable salt by a known method; conversely, when the peptide is obtained in the form of a salt, the salt can be converted to a free form or other salt by a known method.

The starting compound may also be a salt. Examples of such salt include those exemplified as salts of the exemplified selective GIP agonists mentioned bellow.

For condensation of protected amino acid or peptide, various activation reagents usable for peptide synthesis can be used, which are particularly preferably trisphosphonium salts, tetramethyluronium salts, carbodiimides and the like. Examples of the trisphosphonium salt include benzotriazol-1-yloxytris(pyrrolizino)phosphoniumhexafluorophosphate (PyBOP), bromotris(pyrrolizino)phosphoniumhexafluorophosphate (PyBroP), 7-azabenzotriazol-1-yloxytris(pyrrolizino)phosphoniumhexafluorophosphate (PyAOP), examples of the tetramethyluronium salt include 2-(1H-benzotriazol-1-yl)-1,1,3,3-tetramethyluroniumhexafluorophosphate (HBTU), 2-(7-azabenzotriazol-1-yl)-1,1,3,3-tetramethyluroniumhexafluorophosphate (HATU), 2-(1H-benzotriazol-1-yl)-1,1,3,3-tetramethyluroniumtetrafluoroborate (TBTU), 2-(5-norbornane-2,3-dicarboxyimide)-1,1,3,3-tetramethyluroniumtetrafluoroborate (TNTU), O—(N-succimidyl)-1,1,3,3-tetramethyluroniumtetrafluoroborate (TSTU), and examples of the carbodiimide include N,N'-Dicyclohexylcarbodiimide (DCC), N,N'-diisopropylcarbodiimide (DIPCDI), N-ethyl-N'-(3-dimethylaminopropyl)carbodiimide hydrochloride (EDCI·HCl) and the like. For condensation using these, addition of a racemization inhibitor [e.g., N-hydroxy-5-norbornene-2,3-dicarboxylic imide (HONB), 1-hydroxybenzotriazole (HOBt), 1-Hydroxy-7-azabenzotriazole (HOAt), 3,4-Dihydro-3-hydroxy-4-oxo-1,2,3-benzotriazine (HOOBt), ethyl 2-cyano-2-(hydroxyimino)acetate (Oxyma)etc.] is preferable. A solvent to be used for the condensation can be appropriately selected from those known to be usable for peptide condensation reaction. For example, acid amides such as anhydrous or water-containing N,N-dimethylformamide, N,N-dimethylacetamide, N-methylpyrrolidone and the like, halogenated hydrocarbons such as methylene chloride, chloroform and the like, alcohols such as trifluoroethanol, phenol and the like, sulfoxides such as dimethylsulfoxide and the like, tertiary amines such as pyridine and the like, ethers such as dioxane, tetrahydrofuran and the like, nitriles such as acetonitrile, propionitrile and the like, esters such as methyl acetate, ethyl acetate and the like, an appropriate mixture of these and the like can be used. Reaction temperature is appropriately selected from the range known to be usable for peptide binding reactions, and is normally selected from the range of about -20° C. to 90° C. An activated amino acid derivative is normally used from 1.5 to 6 times in excess. In solid phase synthesis, when a test using the ninhydrin reaction reveals that the condensation is insufficient, sufficient condensation can be conducted by repeating the condensation reaction without elimination of protecting groups. If the condensation is yet insufficient even after repeating the reaction, unreacted amino acids can be acylated with acetic anhydride, acetylimidazole or the like so that an influence on the subsequent reactions can be avoided.

Examples of the protecting groups for the amino groups of the starting amino acid include benzyloxycarbonyl (Z), tert-butoxycarbonyl (Boc), tert-pentyloxycarbonyl, isobornyloxycarbonyl, 4-methoxybenzyloxycarbonyl, 2-chlorobenzyloxycarbonyl (Cl-Z), 2-bromobenzyloxycarbonyl (Br-Z), adamantyloxycarbonyl, trifluoroacetyl, phthaloyl, formyl, 2-nitrophenylsulphenyl, diphenylphosphinothioyl, 9-fluorenylmethyloxycarbonyl (Fmoc), trityl and the like.

Examples of the carboxyl-protecting group for the starting amino acid include aryl, 2-adamantyl, 4-nitrobenzyl, 4-methoxybenzyl, 4-chlorobenzyl, phenacyl and benzyloxycarbonylhydrazide, tert-butoxycarbonylhydrazide, tritylhydrazide and the like, in addition to the above-mentioned $C_{1-6}$ alkyl group, $C_{3-10}$ cycloalkyl group, $C_{7-14}$ aralkyl group.

The hydroxyl group of serine or threonine can be protected, for example, by esterification or etherification. Examples of the group suitable for the esterification include lower ($C_{2-4}$) alkanoyl groups such as an acetyl group and the like, aroyl groups such as a benzoyl group and the like, and the like, and a group derived from an organic acid and the like. In addition, examples of the group suitable for etherification include benzyl, tetrahydropyranyl, tert-butyl(Bu$^t$), trityl (Trt) and the like.

Examples of the protecting group for the phenolic hydroxyl group of tyrosine include Bzl, 2,6-dichlorobenzyl, 2-nitrobenzyl, Br-Z, tert-butyl and the like.

Examples of the protecting group for the imidazole of histidine include p-toluenesulfonyl (Tos), 4-methoxy-2,3,6-trimethylbenzenesulfonyl (Mtr), dinitrophenyl (DNP), benzyloxymethyl (Bom), tert-butoxymethyl (Bum), Boc, Trt, Fmoc and the like.

Examples of the protecting group for the guanidino group of arginine include Tos, Z, 4-methoxy-2,3,6-trimethylbenzenesulfonyl (Mtr), p-methoxybenzenesulfonyl (MBS), 2,2,5,7,8-pentamethylchromane-6-sulfonyl (Pmc), mesitylene-2-sulfonyl (Mts), 2,2,4,6,7-pentamethyldihydrobenzofuran-5-sulfonyl (Pbf), Boc, Z, $NO_2$ and the like.

Examples of the protecting group for a side chain amino group of lysine include Z, Cl-Z, trifluoroacetyl, Boc, Fmoc, Trt, Mtr, 4,4-dimethyl-2,6-dioxocyclohexylideneyl (Dde) and the like.

Examples of the protecting group for indolyl of tryptophan include formyl (For), Z, Boc, Mts, Mtr and the like.

Examples of the protecting group for asparagine and glutamine include Trt, xanthyl (Xan), 4,4'-dimethoxybenzhydryl (Mbh), 2,4,6-trimethoxybenzyl (Tmob) and the like.

Examples of activated carboxyl groups in the starting material include corresponding acid anhydride, azide, active esters [ester with alcohol (e.g., pentachlorophenol, 2,4,5-trichlorophenol, 2,4-dinitrophenol, cyanomethylalcohol, paranitrophenol, HONB, N-hydroxysuccimide, 1-hydroxybenzotriazole (HOBt), 1-hydroxy-7-azabenzotriazole (HOAt))] and the like. Examples of the activated amino group in the starting material include corresponding phosphorous amide.

Examples of the method for removing (eliminating) a protecting group include a catalytic reduction in a hydrogen stream in the presence of a catalyst such as Pd-black or Pd-carbon; an acid treatment using anhydrous hydrogen fluoride, methanesulfonic acid, trifluoromethanesulfonic acid, trifluoroacetic acid (TFA), trimethylsilyl bromide (TMSBr), trimethylsilyl trifluoromethanesulfonate, tetrafluoroboric acid, tris(trifluoro)boric acid, boron tribromide, or a mixture solution thereof; a base treatment using diisopropylethylamine, triethylamine, piperidine, piperazine or the like; and reduction with sodium in liquid ammonia, and the like. The elimination reaction by the above-described acid treatment is generally carried out at a temperature of -20° C. to 40° C.; the acid treatment is efficiently conducted by adding a cation scavenger such as anisole, phenol, thioanisole, metacresol and paracresol; dimethylsulfide, 1,4-butanedithiol, 1,2-ethanedithiol, triisopropylsilane and the like. Also, a 2,4-dinitrophenyl group used as a protecting group of the imidazole of histidine is removed by thiophenol treatment; a formyl group used as a protecting group of the indole of tryptophan is removed by deprotection by acid treatment in the presence of 1,2-ethanedithiol, 1,4-butanedithiol, or the like, as well as by alkali treatment with dilute sodium hydroxide, dilute ammonia, or the like.

Protection of a functional group that should not be involved in the reaction of a starting material and a protecting group, elimination of the protecting group, activation of a functional group involved in the reaction and the like can be appropriately selected from known protecting groups and known means.

In a method of preparing an amide of the peptide, it is formed by a solid phase synthesis using a resin for amide synthesis, or the α-carboxyl group of the carboxy terminal amino acid is amidated, and a peptide chain is elongated to a desired chain length toward the amino group side, thereafter a peptide wherein the protecting group for the N-terminal α-amino group of the peptide chain only removed and a peptide wherein the protecting group for the C-terminal carboxyl group only removed of the peptide chain are prepared, and the both peptides are condensed in a mixed solvent described above. For details about the condensation reaction, the same as above applies. After the protected peptide obtained by the condensation is purified, all protecting groups can be removed by the above-described method to yield a desired crude polypeptide. By purifying this crude peptide using various publicly known means of purification, and freeze-drying the main fraction, a desired amide of the peptide can be prepared.

When the GIP receptor agonist peptide is present as a configurational isomer such as enantiomer, diastereomer etc., a conformer or the like, they are also encompassed within the description of a GIP receptor agonist peptide and each can be isolated by a means known per se or the above separation and purification methods on demand. In addition, when the GIP receptor agonist peptide is in the form of a racemate, it can be separated into S- and R-forms by conventional optical resolution.

When a GIP receptor agonist peptide includes stereoisomers, both the isomers alone and mixtures of each isomers are also encompassed within the meaning of a GIP receptor agonist peptide. A GIP receptor agonist peptide can be chemically modified according to a method known per se and using substituent and polyethylene glycol. For example, a chemically modified GIP receptor agonist peptide can be produced by introducing substituent and/or conjugatedly binding polyethylene glycol to Cys residue, Asp residue, Glu residue, Lys residue and the like of a GIP receptor agonist peptide. Additionally, there may be a linker structure between the amino acid of the GIP receptor agonist peptide and substituent and polyethylene glycol.

A GIP receptor agonist peptide modified by a substituent and/or polyethylene glycol (PEG) produces for example, one or more effects related to promoting the biological activity, prolonging the blood circulation time, reducing the immunogenicity, enhancing the solubility, and enhancing the resistance to metabolism, of a therapeutically and diagnostically important peptide.

The molecular weight of PEG is not particularly limited and is normally about 1 K to about 1000 K daltons, preferably about 10 K to about 100 K daltons, more preferably about 20 K to about 60 K Daltons.

Modifying a selective GIP agonist of the present disclosure by adding an (R) substituent can be conducted by introducing the (R) substituent based on known oxidation reaction and reduction reaction.

A method well known in the art can be used as a method for modifying a GIP receptor agonist peptide by PEG, and, for example, in addition to the exemplary methods listed above, the methods described below can be used.

(1) A PEGylating reagent having an active ester (e.g., SUNBRIGHT MEGC-30TS (trade name), NOF Corp.) is bound to an amino group of the GIP receptor agonist peptide.

(2) A PEGylating reagent having an aldehyde (e.g., SUNBRIGHT ME-300AL (trade name), NOF Corp.) is bound to the amino group of the GIP receptor agonist peptide.

(3) A divalent cross-linking reagent (e.g., GMBS (Dojindo Laboratories), EMCS (Dojindo Laboratories), KMUS (Dojindo Laboratories), SMCC (Pierce)) is bound to an amino acid, (for example, a Lys and/or a Cys), of the GIP receptor agonist peptide, to which a PEGylating reagent having a thiol group (e.g., SUNBRIGHT ME-300-SH (trade name), NOF Corp.) is then bound.

(4) A thiol group is introduced to a GIP receptor agonist peptide through an SH-introducing agent (e.g., D-cysteine residue, L-cysteine residue, Traut's reagent), and this thiol group is reacted with a PEGylating reagent having a maleimide group (e.g., SUNBRIGHT ME-300MA (trade name), NOF Corp.).

(5) A thiol group is introduced to GIP receptor agonist peptide through an SH-introducing agent (e.g., D-cysteine residue, L-cysteine residue, Traut's reagent), and this thiol group is reacted with a PEGylating reagent having an iodoacetamide group (e.g., SUNBRIGHT ME-300IA (trade name), NOF Corp.).

(6) A ω-aminocarboxylic acid, an α-amino acid or the like is introduced as a linker to the N-terminal amino group of a GIP receptor agonist peptide, and an amino group derived from this linker is reacted with a PEGylating reagent having an active ester (e.g., SUNBRIGHT MEGC-30TS (trade name), NOF Corp.).

(7) A ω-aminocarboxylic acid, an α-amino acid or the like is introduced as a linker to the N-terminal amino group of a GIP receptor agonist peptide, and an amino group derived from this linker is reacted with a PEGylating reagent having an aldehyde group (e.g., SUNBRIGHT ME-300AL (trade name), NOF Corp.).

In addition, the GIP receptor agonist peptide may be a solvate (e.g., hydrate) or a non-solvate (e.g., non-hydrate).

The GIP receptor agonist peptide may be labeled with an isotope (e.g., $^3$H, $^{14}$C, $^{35}$S, $^{125}$I) or the like.

Furthermore, GIP receptor agonist peptide may be a deuterium conversion form wherein $^1$H is converted to $^2$H(D).

In some embodiments, a GIP receptor agonist peptide labeled with or substituted with an isotope can be used as, for example, a tracer (PET tracer) for use in Positron Emission Tomography (PET), and is useful in the fields of medical diagnosis and the like.

For the GIP receptor agonist peptide mentioned herein, the left end is the N-terminal (amino terminal) and the right end is the C-terminal (carboxyl terminal) in accordance with the conventional peptide marking. The C-terminal of peptide may be any of an amide (—CONH$_2$), a carboxyl group (—COOH), a carboxylate (—COO$^-$), an alkylamide (—CONHR$^a$), and an ester (—COOR$^a$). Particularly, amide (—CONH$_2$) is preferable.

A GIP receptor agonist peptide of the present disclosure may be in a salt form. Examples of such salt include metal salts, ammonium salts, salts with organic base, salts with inorganic acid, salts with organic acid, salts with basic or acidic amino acid, and the like.

Preferable examples of the metal salt include alkali metal salts such as sodium salt, potassium salt and the like; alkaline earth metal salts such as calcium salt, magnesium salt, barium salt and the like; aluminum salt and the like.

Preferable examples of the salt with organic base include salts with trimethylamine, triethylamine, pyridine, picoline, 2,6-lutidine, ethanolamine, diethanolamine, triethanolamine, cyclohexylamine, dicyclohexylamine, N,N-dibenzylethylenediamine and the like.

Preferable examples of the salt with inorganic acid include salts with hydrochloric acid, hydrobromic acid, nitric acid, sulfuric acid, phosphoric acid and the like.

Preferable examples of the salt with organic acid include salts with formic acid, acetic acid, trifluoroacetic acid, phthalic acid, fumaric acid, oxalic acid, tartaric acid, maleic acid, citric acid, succinic acid, malic acid, methanesulfonic acid, benzenesulfonic acid, p-toluenesulfonic acid and the like.

Preferable examples of the salt with basic amino acid include salts with arginine, lysine, ornithine and the like. Preferable examples of the salt with acidic amino acid include salts with aspartic acid, glutamic acid and the like.

Among the above-mentioned salts, a pharmaceutically acceptable salt is preferable. For example, when a compound has an acidic functional group, an inorganic salt such as alkali metal salt (e.g., sodium salt, potassium salt etc.), alkaline earth metal salt (e.g., calcium salt, magnesium salt, barium salt etc.) and the like, ammonium salt etc., and when a compound has a basic functional group, for example, a salt with inorganic acid such as hydrochloric acid, hydrobromic acid, nitric acid, sulfuric acid, phosphoric acid and the like, or a salt with organic acid such as acetic acid, phthalic acid, fumaric acid, oxalic acid, tartaric acid, maleic acid, citric acid, succinic acid, methanesulfonic acid, p-toluenesulfonic acid and the like are preferable.

In some embodiments, the GIP receptor agonist peptide may be synthesized and/or used in a prodrug form to treat or prevent a disease of the present disclosure, for example, diabetes, obesity and/or emesis. A prodrug means a compound which is converted to a GIP receptor agonist peptide with a reaction due to an enzyme, gastric acid, etc. under the physiological condition in the living body, that is, a compound which is converted to a GIP receptor agonist peptide with oxidation, reduction, hydrolysis, etc. according to an enzyme; a polypeptide which is converted to GIP receptor agonist peptide by hydrolysis etc. due to gastric acid, etc.

Examples of a prodrug of a GIP receptor agonist peptide may include a compound wherein an amino group of a GIP receptor agonist peptide is acylated, alkylated or phosphorylated (e.g., compound wherein amino group of a GIP receptor agonist peptide is eicosanoylated, alanylated, pentylaminocarbonylated, (5-methyl-2-oxo-1,3-dioxolen-4-yl)methoxycarbonylated, tetrahydrofuranylated, pyrrolidylmethylated, pivaloyloxymethylated or tert-butylated, and the like); a compound wherein a hydroxy group of a GIP receptor agonist peptide is acylated, alkylated, phosphorylated or borated (e.g., a compound wherein a hydroxy group of a GIP receptor agonist peptide is acetylated, palmitoylated, propanoylated, pivaloylated, succinylated, fumarylated, alanylated or dimethylaminomethylcarbonylated); a compound wherein a carboxy group of a GIP receptor agonist peptide is esterified or amidated (e.g., a compound wherein a carboxy group of a GIP receptor agonist peptide is $C_{1-6}$ alkyl esterified, phenyl esterified, carboxymethyl esterified, dimethylaminomethyl esterified, pivaloyloxymethyl esterified, ethoxycarbonyloxyethyl esterified, phthalidyl esterified, (5-methyl-2-oxo-1,3-dioxolen-4-yl)methyl esterified, cyclohexyloxycarbonylethyl esterified or methylamidated) and the like. Among others, a compound wherein a carboxy group of a GIP receptor agonist peptide is esterified with $C_{1-6}$ alkyl such as methyl, ethyl, tert-butyl or the like is preferably used. These compounds, peptides and polypeptides can be produced from a GIP receptor agonist peptide by a method known per se.

A prodrug of a GIP receptor agonist peptide may also be one which is converted into a GIP receptor agonist peptide under a physiological condition, such as those described in IYAKUHIN no KAIHATSU (Development of Pharmaceuticals), Vol. 7, Design of Molecules, p. 163-198, Published by HIROKAWA SHOTEN (1990).

In the present specification, the prodrug may form a salt. Examples of such a salt include those exemplified as the salt of a GIP receptor agonist peptide.

In some embodiments, a GIP receptor agonist peptide of the present disclosure may be synthesized and/or used as a crystal. Crystals having a singular crystal form or a mixture of plural crystal forms are also encompassed by the examples of GIP receptor agonist peptides. Crystals can be produced by crystallizing a GIP receptor agonist peptide according to a crystallization method known per se.

In addition, a GIP receptor agonist peptide may be a pharmaceutically acceptable cocrystal or cocrystal salt. Here, the cocrystal or cocrystal salt means a crystalline substance consisting of two or more particular substances which are solids at room temperature, each having different physical properties (e.g., structure, melting point, heat of melting, hygroscopicity, solubility, stability etc.). The cocrystal and cocrystal salt can be produced by cocrystallization known per se.

The crystal of a GIP receptor agonist peptide of the present disclosure is superior in physicochemical properties (e.g., melting point, solubility, stability) and biological properties (e.g., pharmacokinetics (absorption, distribution, metabolism, excretion), efficacy expression), and thus it is extremely useful as a medicament.

In some embodiments, a GIP receptor agonist peptide and/or a prodrug thereof (hereinafter to be sometimes abbreviated as a GIP receptor agonist peptide of the present disclosure) have a GIP receptor activating action, and may have selectivity as agonists of the GIP receptor over other receptors such as the GLP1R. The compounds of the present disclosure have a high GIP receptor selective activation action in vivo.

C. METHODS OF PROPHYLAXIS AND TREATMENT OF GIP MEDIATED CONDITIONS, DISEASES, AND DISORDERS

GIP is a gastrointestinal hormone called incretin and has a promoting action on insulin secretion from the pancreas. Incretin is closely related to glucose metabolism and thus the compound having a GIP receptor activation action is useful for preventing and treating symptoms related to abnormal glucose metabolism including diabetes and obesity. Additionally, the compounds of the present disclosure have a GIP receptor selective activation action and suppresses vomiting by activating GABAergic neurons in the area postrema.

More specifically, the GIP receptor agonist peptides of the present disclosure have a hypoglycemic action, an antiemetic action, and the like.

The GIP receptor agonist peptides of the present disclosure have a high chemical stability and excellent persistence of the effects in vivo.

The GIP receptor agonist peptides of the present disclosure may be used as a GIP receptor activator.

In the present disclosure, the GIP receptor activator (GIP receptor agonist) means an agent having a GIP receptor activation action. Additionally, the GIP receptor selective activator (GIP receptor peptide agonist) specifically means an agent having an $EC_{50}$ for the GIP receptor of 1/10 or less, or 1/100 or less, or 1/1000 or less, and preferably 1/10000 or less, times the $EC_{50}$ for the GLP-1 receptor.

The GIP receptor agonist peptides of the present disclosure is low in its toxicity (e.g., acute toxicity, chronic toxicity, genetic toxicity, reproductive toxicity, cardiac toxicity, carcinogenicity), shows a few side effects, and can be safely administered to a mammal (e.g., human, bovine, horse, dog, cat, monkey, mouse, rat) as an agent for the prophylaxis or treatment of various diseases mentioned below and the like.

The GIP receptor agonist peptides of the present disclosure can be used as an agent for the treatment or prophylaxis of various diseases including diabetes and obesity, by virtue of the above-mentioned activating action on GIP receptors. The GIP receptor agonist peptides of the present disclosure can be used as an agent for the prophylaxis or treatment of, for example, symptomatic obesity, obesity based on simple obesity, disease state or disease associated with obesity, eating disorder, diabetes (e.g., type 1 diabetes, type 2 diabetes, gestational diabetes, obese diabetes), hyperlipidemia (e.g., hypertriglyceridemia, hypercholesterolemia, high LDL-cholesterolemia, low HDL-cholesterolemia, postprandial hyperlipemia), hypertension, cardiac failure, diabetic complications [e.g., neuropathy, nephropathy, retinopathy, diabetic cardiomyopathy, cataract, macroangiopathy, osteopenia, hyperosmolar diabetic coma, infectious disease (e.g., respiratory infection, urinary tract infection, gastrointestinal infection, dermal soft tissue infections, inferior limb infection), diabetic gangrene, xerostomia, hypacusis, cerebrovascular disorder, peripheral blood circulation disorder], metabolic syndrome (disease states having 3 or more selected from hypertriglyceridemia, (TG), low HDL cholesterol (HDL-C)emia, hypertension, abdominal obesity and impaired glucose tolerance), sarcopenia and the like.

Examples of the symptomatic obesity include endocrine obesity (e.g., Cushing syndrome, hypothyroidism, insulinoma, obese type II diabetes, pseudohypoparathyroidism, hypogonadism), central obesity (e.g., hypothalamic obesity, frontal lobe syndrome, Kleine-Levin syndrome), hereditary obesity (e.g., Prader-Willi syndrome, Laurence-Moon-Biedl syndrome), drug-induced obesity (e.g., steroid, phenothiazine, insulin, sulfonylurea (SU) agent, β-blocker-induced obesity) and the like.

Examples of the disease state or disease associated with obesity include glucose tolerance disorders, diabetes (particularly type 2 diabetes (T2DM), obese diabetes), lipid metabolism abnormality (synonymous with the above-mentioned hyperlipidemia), hypertension, cardiac failure, hyperuricemia.gout, fatty liver (including non-alchoholic steatohepatitis), coronary heart disease (myocardial infarction, angina pectoris), cerebral infarction (brain thrombosis, transient cerebral ischemic attack), bone/articular disease (knee osteoarthritis, hip osteoarthritis, spondylitis deformans, lumbago), sleep apnea syndrome/Pickwick syndrome, menstrual disorder (abnormal menstrual cycle, abnormality of menstrual flow and cycle, amenorrhea, abnormal catamenial symptom), metabolic syndrome and the like.

New diagnostic criteria were reported by The Japan Diabetes Society in 1999 about the diagnostic criteria of diabetes.

According to this report, diabetes refers to a state that meets any of a fasting blood glucose level (glucose concentration in venous plasma) of 126 mg/dl or more, a 2-hr value (glucose concentration in venous plasma) of 200 mg/dl or more in the 75 g oral glucose tolerance test (75 g OGTT), and a casual blood glucose level (glucose concentration in venous plasma) of 200 mg/dl or more. Also, a state that does not apply to the above-mentioned diabetes, and is not a state exhibiting "a fasting blood glucose level (glucose concentration in venous plasma) less than 110 mg/dl or a 2-hr value (glucose concentration in venous plasma) less than 140 mg/dl in the 75 g oral glucose tolerance test (75 g OGTT)" (normal type) is called "borderline type".

Moreover, new diagnostic criteria were reported by American Diabetes Association (ADA) in 1997 and by World Health Organization (WHO) in 1998 about the diagnostic criteria of diabetes.

According to these reports, diabetes refers to a state that meets a fasting blood glucose level (glucose concentration in venous plasma) of 126 mg/dl or more and a 2-hr value (glucose concentration in venous plasma) of 200 mg/dl or more in the 75 g oral glucose tolerance test.

According to the above-mentioned reports, impaired glucose tolerance refers to a state that meets a fasting blood glucose level (glucose concentration in venous plasma) less than 126 mg/dl and a 2-hr value (glucose concentration in venous plasma) of 140 mg/dl or more and less than 200 mg/dl in the 75 g oral glucose tolerance test. According to the report of ADA, a state exhibiting a fasting blood glucose level (glucose concentration in venous plasma) of 110 mg/dl or more and less than 126 mg/dl is called IFG (Impaired Fasting Glucose). On the other hand, according to the report of WHO, a state of the IFG (Impaired Fasting Glucose) exhibiting a 2-hr value (glucose concentration in venous plasma) less than 140 mg/dl in the 75 g oral glucose tolerance test is called IFG (Impaired Fasting Glycemia).

The GIP receptor agonist peptides of the present disclosure may also be used as an agent for the prophylaxis or treatment of diabetes determined according to the above-mentioned new diagnostic criteria, borderline type diabetes, impaired glucose tolerance, IFG (Impaired Fasting Glucose) and IFG (Impaired Fasting Glycemia). Moreover, the GIP receptor agonist peptides of the present disclosure can prevent progress of borderline type, impaired glucose tolerance, IFG (Impaired Fasting Glucose) or IFG (Impaired Fasting Glycemia) into diabetes.

The GIP receptor agonist peptides of the present disclosure are also useful as an agent for the prophylaxis or treatment of metabolic syndrome. The incidence of cardiovascular disease is significantly high in metabolic syndrome patients, compared with patients with a single lifestyle-related disease. Thus, the prophylaxis or treatment of metabolic syndrome is exceedingly important for preventing cardiovascular disease.

The diagnostic criteria of metabolic syndrome were announced by WHO in 1999 and by NCEP in 2001. According to the diagnostic criteria of WHO, an individual having hyperinsulinemia or abnormal glucose tolerance as a requirement and two or more of visceral obesity, dyslipidemia (high TG or low HDL) and hypertension is diagnosed as having metabolic syndrome (World Health Organization:

Definition, Diagnosis and Classification of Diabetes Mellitus and Its Complications. Part I: Diagnosis and Classification of Diabetes Mellitus, World Health Organization, Geneva, 1999). According to the diagnostic criteria of the Adult Treatment Panel III of the National Cholesterol Education Program (guideline of ischemic heart disease) in USA, an individual having three or more of visceral obesity, hypertriglyceridemia, low HDL-cholesterolemia, hypertension and abnormal glucose tolerance is diagnosed as having metabolic syndrome (National Cholesterol Education Program: Executive Summary of the Third Report of National Cholesterol Education Program (NCEP) Expert Panel on Detection, Evaluation, and Treatment of High Blood Cholesterol in Adults (Adults Treatment Panel III). The Journal of the American Medical Association, Vol. 285, 2486-2497, 2001).

More specifically, the GIP receptor agonist peptides of the present disclosure have an antiemetic action, and may inhibit or reduce the number and severity of the occurrence of nausea, and/or vomiting when associated with various stimuli disclosed herein, for example, when a subject has cyclic vomiting syndrome or is administered a chemotherapeutic drug, for example, a chemotherapeutic drug with emetic potential, such as platinum based chemotherapeutics such as cisplatin, oxaliplatin, and carboplatin; irinotecan and other topo isomerase inhibitors used in the treatment of cancer. The GIP receptor agonist peptides of the present disclosure have a high chemical stability and excellent persistence of the effects in vivo.

The GIP receptor agonist peptides of the present disclosure may be used as a GIP receptor activator. In the present disclosure, the GIP receptor activator (GIP receptor agonist) means an agent having a GIP receptor activation action. Additionally, the GIP receptor selective activator (i.e. a GIP receptor agonist as used herein) specifically means an agent having an $EC_{50}$ for the GIP receptor of $1/1000$ or less, and preferably $1/10000$ or less, times the $EC_{50}$ for the GLP-1 receptor, or in other words the ratio of $EC_{50}$ GLP1R/$EC_{50}$ GIPR is greater than 10, greater than 100, or greater than 1,000, or greater than 10,000, or from 100 to 1,000,000 or more.

The GIP receptor agonist peptides of the present disclosure have low toxicity (e.g., acute toxicity, chronic toxicity, genetic toxicity, reproductive toxicity, cardiac toxicity, carcinogenicity), shows a few side effects, and can be safely administered to a mammal (e.g., human, bovine, horse, dog, cat, monkey, mouse, rat) as an agent for the prophylaxis or treatment of emesis.

"Treatment," in the context of treating emesis by administering at least one of the GIP receptor agonist peptides disclosed herein, includes both prophylactic treatment and the treatment of emesis after a subject experiences emesis. Prophylactic treatment includes administration of a GIP receptor agonist peptide before a subject experiences emesis, such as when the subject experiences nausea, as well as administration of the GIP receptor agonist peptide before the subject is exposed to a substance, agent, or event, or before the subject contracts a condition, which results in or is likely to result in the subject experiencing emesis. As used herein, "therapeutically effective amount" refers to an amount of the GIP receptor agonist peptide sufficient to elicit the desired biological response. In the present disclosure, the desired biological response is treating and/or preventing an abnormal glucose metabolism in a subject, for example, in a subject in need thereof, including diabetes and obesity, or the prevention and/or treatment of emesis in a subject in need thereof.

The GIP receptor agonist peptides of the present disclosure can be used to treat or prevent diabetes and/or obesity, a pathophysiological condition related to diabetes and/or obesity, emesis, for example, when a subject experiences or is about to experience emesis, such as nausea and/or vomiting. In various embodiments, the subject, for example, a mammal, for example, humans, non-human primates, apes, monkeys, laboratory mammals for example, mice, rats, rabbits, guinea-pigs, ferrets, domesticated mammals, such as companion mammals, dogs, cats and horses, and farm mammals, such as cattle, pigs, sheep and goats purely as examples, but not intended to be an exhaustive list, may be treated with a GIP receptor agonist peptide of the present disclosure. In each of these cases, the methods of the present disclosure are provided to treat or prevent diabetes, obesity, or emesis in a subject in need thereof, to reduce or inhibit diabetes, obesity, or emesis, to reduce or inhibit a symptom associated with diabetes, obesity, or emesis, or to reduce or inhibit a pathological condition or symptom associated with diabetes, obesity, or emesis, for example, nausea and/or vomiting.

In order to prevent or treat emesis, an effective amount of one or more of the present compounds in a pharmaceutical composition is administered to a subject/patient (used interchangeably herein) in need thereof. A subject is determined to be in need of treatment with the present GIP receptor agonist peptide either through observation of vomiting by the subject, or through a subject's self-reporting of emesis (in the case of a human subject). A patient is determined to be in need of preventative therapy by assessing that the patient is at risk of experiencing emesis due to another medical condition or due to exposure to an agent known to be associated with emesis, such as an infection by a virus or bacteria or chemical agent or radiation.

The present GIP receptor agonist peptides are beneficial in the therapy of acute, delayed or anticipatory emesis, including emesis induced by chemotherapy, radiation, toxins, viral or bacterial infections, pregnancy, vestibular disorders (e.g. motion sickness, vertigo, dizziness and Meniere's disease), surgery, pain, opioid use and withdrawal, migraine, and variations in intracranial pressure. The uses of this invention are of particular benefit in the therapy of emesis induced by radiation, for example during the treatment of cancer, or radiation sickness, and in the treatment of post-operative nausea and vomiting. Most especially, use of the invention is beneficial in the therapy of emesis induced by antineoplastic (cytotoxic) agents including those routinely used in cancer chemotherapy, emesis induced by other pharmacological agents, for example, alpha-2 adrenoceptor antagonists, such as yohimbine, MK-912 and MK-467, and type IV cyclic nucleotide phosphodiesterase (PDE4) inhibitors, such as RS14203, CT-2450 and rolipram.

Particular examples of chemotherapeutic agents are described, for example, by D. J. Stewart in Nausea and Vomiting: Recent Research and Clinical Advances, ed. J. Kucharczyk et al., CRC Press Inc., Boca Raton, Fla., USA, 1991, pages 177-203, especially page 188. Commonly used chemotherapeutic agents include cisplatin, carboplatin, oxaliplatin, cyclophosphamide, dacarbazine (DTIC), dactinomycin, mechlorethamine (nitrogen mustard), streptozocin, cyclophosphamide, carmustine (BCNU), irinotecan, and other topoisomerase inhibitors, lomustine (CCNU), doxorubicin (adriamycin), daunorubicin, procarbazine, mitomycin, cytarabine, etoposide, methotrexate, 5-fluorouracil, vinblastine, vincristine, bleomycin, paclitaxel and chlorambucil (R. J. Gralle et al. in Cancer Treatment Reports, 1984, 68, 163-172). Emesis due to other chemical agents, such as the toxins soman or sarin, or opiod drug usage and/or withdrawal, e.g. morphine, heroin, oxycodone, and the like can also be prevented and/or treated.

The present compounds are administered to a patient in a quantity sufficient to treat or prevent the symptoms and/or underlying etiology associated with emesis in the patient. In a preferred embodiment, the GIP receptor agonist peptides are administered prior to administration of an agent which is likely to cause emesis, such as one or more of the chemotherapeutic agents described above. The present GIP receptor agonist peptides can also be administered in combination with such agents, either in physical combination or in combined therapy through the administration of the present compounds and agents in succession (in any order). Although the present invention is useful in any mammal suffering from emesis, a preferred subject is a human.

In some embodiments, the selective GIP agonists of the present disclosure may be administered to treat emesis when a subject is concomitantly being treated for diabetes and/or obesity. Several known anti-diabetic medicaments are known for causing emesis, for example, Metformin (Glucophage, Glumetza, others), sulfonylureas, meglitinides, thiazolidinediones, DPP-4 inhibitors, SGLT2 inhibitors, and GLP-1 receptor agonists. In some embodiments, methods for treating emesis in a subject, for example in a subject in need thereof, may include administering an effective amount of a GIP receptor agonist peptide to a subject that does not have type-2 diabetes mellitus or a subject that is not taking a medicament to treat type-2 diabetes mellitus while experiencing emesis.

Nausea is a subjective unpleasant feeling in the back of one's throat and stomach that may lead to vomiting. There are many words that describe nausea including, but not limited to: sick to my stomach, queasy, or upset stomach. Nausea can have other symptoms that happen at the same time, such as increased saliva (spit), dizziness, light-headedness, trouble swallowing, skin temperature changes, and a fast heart rate. Vomiting is also described as "throwing up." When one vomits, one's stomach muscles contract (squeeze) and push the contents of one's stomach out through their mouth. One might or might not feel nauseated. Retching is when one tries to vomit without bringing anything up from one's stomach. Other words used to describe retching are gagging or dry heaves. Nausea and vomiting often happen at the same time, but they can be 2 different conditions that may be mutually exclusive or mutually associated. Some chemotherapy drugs are more likely to cause nausea and vomiting than others. Doctors classify chemotherapy drugs according to their emetogenic potential (how likely the drug will cause nausea or vomiting) as high, moderate, low, or minimal risk.

The GIP receptor agonist peptides of the present disclosure may be used as a preventive/therapeutic agent for vomiting and/or nausea caused, for example, by clinical pathological conditions or causes described in the following (1) to (10). Additionally, the GIP receptor agonist peptide of the present disclosure may be used as a preventive/therapeutic agent for chronic unexplained nausea and vomiting. The vomiting or nausea also includes imminent unpleasant sensations of wanting to eject the contents of the stomach through the mouth such as feeling queasy and retching, and may also be accompanied by autonomic symptoms such as facial pallor, cold sweat, salivary secretion, tachycardia, and diarrhea. The vomiting also includes acute vomiting, protracted vomiting, and anticipatory vomiting.

(1) Diseases accompanied by vomiting or nausea such as gastroparesis, gastrointestinal hypomotility, peritonitis, abdominal tumor, constipation, gastrointestinal obstruction, chronic intestinal pseudo-obstruction, functional dyspepsia, cyclic vomiting syndrome, chronic unexplained nausea and vomiting, acute pancreatitis, chronic pancreatitis, hepatitis, hyperkalemia, cerebral edema, intracranial lesion, metabolic disorder, gastritis caused by an infection, postoperative disease, myocardial infarction, migraine, intracranial hypertension, and intracranial hypotension (e.g., altitude sickness);

(2) Vomiting and/or nausea induced by chemotherapeutic drugs such as (i) alkylating agents (e.g., cyclophosphamide, carmustine, lomustine, chlorambucil, streptozocin, dacarbazine, ifosfamide, temozolomide, busulfan, bendamustine, and melphalan), cytotoxic antibiotics (e.g., dactinomycin, doxorubicin, mitomycin-C, bleomycin, epirubicin, actinomycin D, amrubicin, idarubicin, daunorubicin, and pirarubicin), antimetabolic agents (e.g., cytarabine, methotrexate, 5-fluorouracil, enocitabine, and clofarabine), vinca alkaloids (e.g., etoposide, vinblastine, and vincristine), other chemotherapeutic agents such as cisplatin, procarbazine, hydroxyurea, azacytidine, irinotecan, interferon α, interleukin-2, oxaliplatin, carboplatin, nedaplatin, and miriplatin; (ii) opioid analgesics (e.g., morphine); (iii) dopamine receptor DID2 agonists (e.g., apomorphine); (iv) cannabis and cannabinoid products including cannabis hyperemesis syndrome;

(3) Vomiting or nausea caused by radiation sickness or radiation therapy for the chest, the abdomen, or the like used to treat cancers;

(4) Vomiting or nausea caused by a poisonous substance or a toxin;

(5) Vomiting and nausea caused by pregnancy including hyperemesis gravidarium; and (6) Vomiting and nausea caused by a vestibular disorder such as motion sickness or dizziness (7) Opioid withdrawal;

(8) Pregnancy including hyperemesis gravidarium;

(9) A vestibular disorder such as motion sickness or dizziness; and

(10) A physical injury causing local, systemic, acute or chronic pain.

These causes of emesis, or nausea, or vomiting are not meant to be exhaustive. Other conditions, activities, side effects may cause emesis, for example, nausea and/or vomiting. Nausea can be measured in ways known to the art, such as through the use of a visual analog scale (VAS).

The compound of the present invention can also be used for secondary prevention or suppression of progression of the above-mentioned various diseases (e.g., cardiovascular events such as myocardial infarction and the like). In addition, the compound of the present invention is also useful as a feeding suppressant and a weight reducing agent. The compound of the present invention can also be used in combination with a diet therapy (e.g., diet therapy for diabetes), and an exercise therapy.

D. FORMULATIONS

A medicament containing a GIP receptor agonist peptide of the present disclosure shows low toxicity and is obtained using the compound of the present disclosure alone or in admixture with a pharmacologically acceptable carrier according to a method known per se (e.g., the method described in the Japanese Pharmacopoeia) generally used as production methods of pharmaceutical preparations, and safely administered orally or parenterally (e.g., topically, rectally, intravenously administered) as a pharmaceutical preparation, for example, tablets (inclusive of sugar-coated tablets, film-coated tablets, sublingual tablets, orally disintegrating tablets), powders, granules, capsules (inclusive of soft capsules, microcapsules), liquids, troches, syrups, emulsions, suspensions, injections (e.g., subcutaneous injections, intravenous injections, intramuscular injections, intraperitoneal injections etc.), external preparations (e.g., transnasal preparations, dermal preparations, ointments), suppository (e.g., rectal suppositories, vaginal suppositories), pellets, nasal preparations, pulmonary preparations (inhalants), transfusions and the like.

These preparations may be controlled release preparations such as a rapid release preparation, a sustained release preparation and the like (e.g., a sustained release microcapsule). The content of the compound of the present disclosure in a pharmaceutical preparation is about 0.01-about 100 wt % of the whole preparation.

The above-mentioned pharmaceutically acceptable carrier may be exemplified by various organic or inorganic carrier materials that are conventionally used as preparation materials, for example, excipient, lubricant, binding agent and disintegrant for solid preparations; or solvent, solubilizing agent, suspending agent, isotonic agent, buffering agent, soothing agent and the like for liquid preparations. Further, if necessary, general additives such as preservative, antioxidant, colorant, sweetening agent, adsorbing agent, wetting agent and the like can be also used appropriately in a suitable amount.

Examples of the excipient include lactose, sucrose, D-mannitol, starch, corn starch, crystalline cellulose, light anhydrous silicic acid and the like.

Examples of the lubricant include magnesium stearate, calcium stearate, talc, colloidal silica and the like.

Examples of the binding agent include crystalline cellulose, sucrose, D-mannitol, dextrin, hydroxypropylcellulose, hydroxypropylmethylcellulose, polyvinylpyrrolidone, starch, sucrose, gelatin, methylcellulose, carboxymethylcellulose sodium and the like.

Examples of the disintegrant include starch, carboxymethylcellulose, carboxymethylcellulose calcium, carboxymethylstarch sodium, L-hydroxypropylcellulose and the like.

Examples of the solvent include water for injection, alcohol, propylene glycol, Macrogol, sesame oil, corn oil, olive oil and the like.

Examples of the solubilizing agent include polyethylene glycol, propylene glycol, D-mannitol, benzyl benzoate, ethanol, trisaminomethane, cholesterol, triethanolamine, sodium carbonate, sodium citrate and the like.

Examples of the suspending agent include surfactants such as stearyl triethanolamine, sodium lauryl sulfate, laurylaminopropionic acid, lecithin, benzalkonium chloride, benzetonium chloride, glycerin monostearate and the like; hydrophilic polymers such as polyvinyl alcohol, polyvinylpyrrolidone, carboxymethylcellulose sodium, methylcellulose, hydroxymethylcellulose, hydroxyethylcellulose, hydroxypropylcellulose and the like; and the like.

Examples of the isotonic agent include glucose, D-sorbitol, sodium chloride, glycerin, D-mannitol and the like.

Examples of the buffering agent include buffer solutions such as phosphates, acetates, carbonates, citrates and the like.

Examples of the soothing agent include benzyl alcohol and the like.

Examples of the preservative include parahydroxybenzoic acid esters, chlorobutanol, benzyl alcohol, phenethyl alcohol, dehydroacetic acid, sorbic acid and the like.

Examples of the antioxidant include sulfites, ascorbic acid, α-tocopherol and the like.

Examples of the colorant include water-soluble food coal tar dyes (e.g., food dyes such as Food Red No. 2 and No. 3, Food Yellow No. 4 and No. 5, Food Blue No. 1 and No. 2, and the like), water-insoluble lake dyes (e.g., aluminum salts of the aforementioned water-soluble Food coal tar dyes), natural dyes (e.g., β-carotene, chlorophyll, ferric oxide red) and the like.

Examples of the sweetening agent include saccharin sodium, dipotassium glycyrrhizinate, aspartame, stevia and the like.

Examples of the adsorbing include porous starch, calcium silicate (trade name: Florite RE), magnesium alumino metasilicate (trade name: Neusilin) and light anhydrous silicic acid (trade name: Sylysia).

Examples of the wetting agent include propylene glycol monostearate, sorbitan monooleate, diethylene glycol monolaurate and polyoxyethylenelauryl ether.

During production of an oral preparation, coating may be applied as necessary for the purpose of masking of taste, enteric property or durability.

Examples of the coating base to be used for coating include sugar coating base, aqueous film coating base, enteric film coating base and sustained-release film coating base.

As the sugar coating base, sucrose is used. Moreover, one or more kinds selected from talc, precipitated calcium carbonate, gelatin, gum arabic, pullulan, carnauba wax and the like may be used in combination.

Examples of the aqueous film coating base include cellulose polymers such as hydroxypropyl cellulose, hydroxypropylmethyl cellulose, hydroxyethyl cellulose, methylhydroxyethyl cellulose etc.; synthetic polymers such as polyvinylacetal diethylaminoacetate, aminoalkyl methacrylate copolymer E [Eudragit E (trade name)], polyvinylpyrrolidone etc.; and polysaccharides such as pullulan etc.

Examples of the enteric film coating base include cellulose polymers such as hydroxypropylmethyl cellulose phthalate, hydroxypropylmethyl cellulose acetate succinate, carboxymethylethyl cellulose, cellulose acetate phthalate etc.; acrylic polymers such as methacrylic acid copolymer L [Eudragit L (trade name)], methacrylic acid copolymer LD [Eudragit L-30D55 (trade name)], methacrylic acid copolymer S [Eudragit S (trade name)] etc.; and naturally occurring substances such as shellac etc.

Examples of the sustained-release film coating base include cellulose polymers such as ethyl cellulose etc.; and acrylic polymers such as aminoalkyl methacrylate copolymer RS [Eudragit RS (trade name)], ethyl acrylate-methyl methacrylate copolymer suspension [Eudragit NE (trade name)] etc.

The above-mentioned coating bases may be used after mixing with two or more kinds thereof at appropriate ratios. For coating, for example, a light shielding agent such as titanium oxide, red ferric oxide and the like can be used.

E. ADMINISTRATION

The therapeutically effective amount or dose of a composition or medicament containing a GIP receptor agonist peptide to be administered to a subject will depend on the age, sex and weight of the patient, and the current medical condition of the patient. The skilled artisan will be able to determine appropriate dosages depending on these and other factors to achieve the desired biological response.

The dosage of the GIP receptor agonist peptide of the present disclosure is appropriately determined according to the subject of administration, symptom, administration method and the like. For example, when the GIP receptor agonist peptide of the present disclosure is administered orally to a subject prior to engaging in an act that will likely cause emesis or after the onset of emesis in a human subject (body weight of approximately 60 kg), the daily dose of the compound of the present disclosure is about 0.01 to 100 mg, preferably about 1.0 to 50 mg, more preferably about 1.0 to 20 mg. When the compound of the present disclosure is administered parenterally to an obesity or diabetes patient or a gastroparesis (body weight 60 kg), the daily dose of the compound of the present disclosure is about 0.001 to 30 mg, preferably about 0.01 to 20 mg, more preferably about 0.1 to 10 mg. These amounts can be administered in about 1 to several portions a day. In some embodiments, a therapeutically effective amount of a GIP receptor agonist peptide to prevent and/or treat emesis in a subject in need thereof may range from about 0.01 to 0.5 mg/kg/day, 0.1 to 5 mg/kg/day, 5 to 10 mg/kg/day, 10 to 20 mg/kg/day, 20 to 50 mg/kg/day, 10 to 100 mg/kg/day, 10 to 120 mg/kg/day, 50 to 100 mg/kg/day, 100 to 200 mg/kg/day, 200 to 300 mg/kg/day, 300 to 400 mg/kg/day, 400 to 500 mg/kg/day, 500 to 600 mg/kg/day, 600 to 700 mg/kg/day, 700 to 800 mg/kg/day, 800 to 900 mg/kg/day or 900 to 1000 mg/kg/day.

The GIP receptor agonist peptide of the present disclosure can be administered, for example, every 2 days, every 3 days, every 4 days, every 5 days, every 6 days, every week, twice per week, every other week, every 3 weeks, every month, every 2 months, every 3 months, every 4 months, every 5 months or every 6 months. In some embodiments, the GIP receptor agonist peptide of the present disclosure can be administered to the subject 1-3 times per day or 1-7 times per week, for 1-5 days, 1-5 weeks, 1-5 months, or 1-5 years.

The GIP receptor agonist peptide of the present disclosure can be used in combination with another drug that does not adversely influence the GIP receptor agonist peptide of the present disclosure, for the purpose of, for example, promoting the action (antiemetic action) of the GIP receptor agonist peptide of the present disclosure, reducing the dose of the GIP receptor agonist peptide of the present disclosure, and the like.

Examples of a drug that can be used in combination with the GIP receptor agonist peptide of the present disclosure (hereinafter sometimes to be abbreviated as a concomitant drug) include anti-obesity agents, therapeutic agents for diabetes, therapeutic agents for diabetic complications, therapeutic agents for hyperlipidemia, antihypertensive agents, diuretics, chemotherapeutics, immunotherapeutics, anti-inflammatory drugs, antithrombotic agents, therapeutic agents for osteoporosis, vitamins, antidementia drugs, erectile dysfunction drugs, therapeutic drugs for urinary frequency or urinary incontinence, therapeutic agents for dysuria, central $D_2$ receptor antagonists, prokinetic agents, antihistamines, muscarine receptor antagonists, serotonin $5HT_3$ receptor antagonists, somatostatin analogues, corticosteroids, benzodiazepine anxiolytics, NK-1 receptor antagonists, hypercalcemia therapeutic drug and the like. Specific examples of the concomitant drug include those mentioned below.

Examples of the anti-obesity agent include monoamine uptake inhibitors (e.g., phentermine, sibutramine, mazindol, fluoxetine, tesofensine), serotonin 2C receptor agonists (e.g., lorcaserin), serotonin 6 receptor antagonists, histamine H3 receptor modulator, GABA modulator (e.g., topiramate), neuropeptide Y antagonists (e.g., velneperit), cannabinoid receptor antagonists (e.g., rimonabant, taranabant), ghrelin antagonists, ghrelin receptor antagonists, ghrelinacylation enzyme inhibitors, opioid receptor antagonists (e.g., GSK-1521498), orexin receptor antagonists, melanocortin 4 receptor agonists, 11β-hydroxysteroid dehydrogenase inhibitors (e.g., AZD-4017), pancreatic lipase inhibitors (e.g., orlistat, cetilistat), β3 agonists (e.g., N-5984), diacylglycerol acyltransferase 1 (DGAT1) inhibitors, acetyl-CoA carboxylase (ACC) inhibitors, stearoyl-CoA desaturated enzyme inhibitors, microsomal triglyceride transfer protein inhibitors (e.g., R-256918), Na-glucose cotransporter inhibitors (e.g., JNJ-28431754, remogliflozin), NFK inhibitory (e.g., HE-3286), PPAR agonists (e.g., GFT-505, DRF-11605), phosphotyrosine phosphatase inhibitors (e.g., sodium vanadate, Trodusquemin), GPR119 agonists (e.g., PSN-821, MBX-2982, APD597), glucokinase activators (e.g., AZD-1656), leptin, leptin derivatives (e.g., metreleptin), CNTF (ciliary neurotrophic factor), BDNF (brain-derived neurotrophic factor), cholecystokinin agonists, amylin preparations (e.g., pramlintide, AC-2307), neuropeptide Y agonists (e.g., PYY3-36, derivatives of PYY3-36, obineptide, TM-30339, TM-30335), oxyntomodulin preparations: FGF21 preparations (e.g., animal FGF21 preparations extracted from the pancreas of bovine or swine; human FGF21 preparations genetically synthesized using *Escherichia coli* or yeast; fragments or derivatives of FGF21), anorexigenic agents (e.g., P-57), GLP-1 receptor agonist, GLP-1 receptor/GIP receptor coagonist, glucagon receptor/GLP-1 receptor/GIP receptor triagonist, and the like.

Here, as the therapeutic agent for diabetes, for example, insulin preparations (e.g., animal insulin preparations extracted from the pancreas of bovine or swine; human insulin preparations genetically synthesized using *Escherichia coli* or yeast; zinc insulin; protamine zinc insulin; fragment or derivative of insulin (e.g., INS-1), oral insulin preparation), insulin sensitizers (e.g., pioglitazone or a salt thereof (preferably, hydrochloride), rosiglitazone or a salt thereof (preferably, maleate), Metaglidasen, AMG-131, Balaglitazone, MBX-2044, Rivoglitazone, Aleglitazar, Chiglitazar, Lobeglitazone, PLX-204, PN-2034, GFT-505, THR-0921, compound described in WO007/013694, WO2007/018314, WO2008/093639 or WO2008/099794), α-glucosidase inhibitors (e.g., voglibose, acarbose, miglitol, emiglitate), biguanides (e.g., metformin, buformin or a salt thereof (e.g., hydrochloride, fumarate, succinate)), insulin secretagogues (e.g., sulfonylurea (e.g., tolbutamide, glibenclamide, gliclazide, chlorpropamide, tolazamide, acetohexamide, glyclopyramide, glimepiride, glipizide, glybuzole), repaglinide, nateglinide, mitiglinide or calcium salt hydrate thereof), dipeptidyl peptidase IV inhibitors (e.g., Alogliptin or a salt thereof (preferably, benzoate), Vildagliptin, Sitagliptin, Saxagliptin, BI1356, GRC8200, MP-513, PF-00734200, PHX1149, SK-0403, ALS2-0426, TA-6666, TS-021, KRP-104, Trelagliptin or a salt thereof (preferably succinate)), β3 agonists (e.g., N-5984), GPR40 agonists (e.g., Fasiglifam or a hydrate thereof, compound described in WO2004/041266, WO2004/106276, WO2005/063729, WO2005/063725, WO2005/087710, WO2005/095338, WO2007/013689 or WO2008/001931), SGLT2 (sodium-glucose cotransporter 2) inhibitors (e.g., Dapagliflozin, AVE2268, TS-033, YM543, TA-7284, Remogliflozin, ASP1941), SGLT1 inhibitors, 11β-hydroxysteroid dehydrogenase inhibitors (e.g., BVT-3498, INCB-13739), adiponectin or agonist thereof, IKK inhibitors (e.g., AS-2868), leptin resistance improving drugs, somatostatin receptor agonists, glucokinase activators (e.g., Piragliatin, AZD1656, AZD6370, TTP-355, compound described in WO006/112549, WO007/028135, WO008/047821, WO008/050821, WO008/136428 or WO008/156757), GPR119 agonists (e.g., PSN821, MBX-2982, APD597), FGF21, FGF analogue, ACC2 inhibitors, GLP-1 receptor agonist, GLP-1 receptor/GIP receptor coagonist, glucagon receptor/GLP-1 receptor/GIP receptor triagonist, and the like can be mentioned.

As the therapeutic agent for diabetic complications may include, aldose reductase inhibitors (e.g., tolrestat, epalrestat, zopolrestat, fidarestat, CT-112, ranirestat (AS-3201), lidorestat), neurotrophic factor and increasing agents thereof (e.g., NGF, NT-3, BDNF, neurotrophic production/secretion promoting agent described in WO01/14372 (e.g., 4-(4-chlorophenyl)-2-(2-methyl-1-imidazolyl)-5-[3-(2-methylphenoxy)propyl]oxazole), compound described in WO2004/039365), PKC inhibitors (e.g., ruboxistaurin mesylate), AGE inhibitors (e.g., ALT946, N-phenacylthiazolium bromide (ALT766), EXO-226, Pyridorin, pyridoxamine), GABA receptor agonists (e.g., gabapentin, pregabalin), serotonin and noradrenalin reuptake inhibitors (e.g., duloxetine), sodium channel inhibitors (e.g., lacosamide), active oxygen scavengers (e.g., thioctic acid), cerebral vasodilators (e.g., tiapuride, mexiletine), somatostatin receptor agonists (e.g., BIM23190), apoptosis signal regulating kinase-1 (ASK-1) inhibitors, GLP-1 receptor agonist, GLP-1 receptor/GIP receptor coagonist, glucagon receptor/GLP-1 receptor/GIP receptor triagonist, and the like can be mentioned.

As the therapeutic agent for hyperlipidemia, HMG-COA reductase inhibitors (e.g., pravastatin, simvastatin, lovastatin, atorvastatin, fluvastatin, rosuvastatin, pitavastatin or a salt thereof (e.g., sodium salt, calcium salt)), squalene synthase inhibitors (e.g., compound described in WO97/10224, for example, N-[[(3R,5S)-1-(3-acetoxy-2,2-dimethylpropyl)-7-chloro-5-(2,3-dimethoxyphenyl)-2-oxo-1,2,3,5-tetrahydro-4,1-benzoxazepin-3-yl]acetyl]piperidin-4-acetic acid), fibrate compounds (e.g., bezafibrate, clofibrate, simfibrate, clinofibrate), anion exchange resin (e.g., colestyramine), probucol, nicotinic acid drugs (e.g., nicomol, niceritrol, niaspan), ethyl icosapentate, phytosterol (e.g., soysterol, gamma oryzanol (γ-oryzanol)), cholesterol absorption inhibitors (e.g., zechia), CETP inhibitors (e.g., dalcetrapib, anacetrapib), ω-3 fatty acid preparations (e.g., ω-3-fatty acid ethyl esters 90 (ω-3-acid ethyl esters 90)) and the like can be mentioned.

Examples of the antihypertensive agent include angiotensin converting enzyme inhibitors (e.g., captopril, enalapril, delapril, etc.), angiotensin II antagonists (e.g., candesartan cilexetil, candesartan, losartan, losartan potassium, eprosartan, valsartan, telmisartan, irbesartan, tasosartan, olmesartan, olmesartan medoxomil, azilsartan, azilsartan medoxomil, etc.), calcium antagonists (e.g., manidipine, nifedipine, amlodipine, efonidipine, nicardipine, cilnidipine, etc.), β blockers (e.g., metoprolol, atenolol, propranolol, carvedilol, pindolol, etc.), clonidine and the like.

As the diuretic, for example, xanthine derivatives (e.g., theobromine sodium salicylate, theobromine calcium salicylate and the like), thiazide preparations (e.g., ethiazide, cyclopenthiazide, trichloromethiazide, hydrochlorothiazide, hydroflumethiazide, benzylhydrochlorothiazide, penfluthiazide, poly5thiazide, methyclothiazide and the like), antialdosterone preparations (e.g., spironolactone, triamterene and the like), carbonic anhydrase inhibitors (e.g., acetazolamide and the like), chlorobenzenesulfonamide agents (e.g., chlortalidone, mefruside, indapamide and the like), azosemide, isosorbide, ethacrynic acid, piretanide, bumetanide, furosemide and the like can be mentioned.

Examples of the chemotherapeutic include alkylating agents (e.g., cyclophosphamide, ifosfamide), antimetabolites (e.g., methotrexate, 5-fluorouracil), anticancer antibiotics (e.g., mitomycin, adriamycin), plant-derived anticancer agents (e.g., vincristine, vindesine, Taxol), cisplatin, carboplatin, etoposide and the like. Among others, a 5-fluorouracil derivative Furtulon or Neofurtulon or the like is preferable. Also a composition comprising a GIP receptor agonist peptide of the disclosure can be administered before, after or during the administration of the following anticancer agents: cisplatin, carboplatin. Oxaliplatin, cyclophosphamide, dacarbazine (DTIC), dactinomycin, mechlorethamine (nitrogen mustard), streptozocin, cyclophosphamide, carmustine (BCNU), lomustine (CCNU), doxorubicin (adriamycin), daunorubicin, procarbazine, mitomycin, cytarabine, etoposide, methotrexate, 5-fluorouracil, vinblastine, vincristine, bleomycin, paclitaxel and chlorambucil.

Examples of the immunotherapeutic include microbial or bacterial components (e.g., muramyl dipeptide derivative, Picibanil), polysaccharides having immunoenhancing activity (e.g., lentinan, sizofiran, Krestin), cytokines obtained by genetic engineering approaches (e.g., interferon, interleukin (IL)), colony-stimulating factors (e.g., granulocyte colony-stimulating factor, erythropoietin) and the like. Among others, interleukins such as IL-1, IL-2, IL-12 and the like are preferable.

Examples of the anti-inflammatory drug include non-steroidal anti-inflammatory drugs such as aspirin, acetaminophen, indomethacin and the like.

As the antithrombotic agent, for example, heparin (e.g., heparin sodium, heparin calcium, enoxaparin sodium, dalteparin sodium), warfarin (e.g., warfarin potassium), antithrombin drugs (e.g., aragatroban, dabigatran), FXa inhibitors (e.g., rivaroxaban, apixaban, edoxaban, YM150, compound described in WO02/06234, WO2004/048363, WO2005/030740, WO2005/058823 or WO2005/113504), thrombolytic agents (e.g., urokinase, tisokinase, alteplase, nateplase, monteplase, pamiteplase), platelet aggregation inhibitors (e.g., ticlopidine hydrochloride, clopidogrel, prasugrel, E5555, SHC530348, cilostazol, ethyl icosapentate, beraprost sodium, sarpogrelate hydrochloride) and the like can be mentioned.

Examples of the therapeutic agent for osteoporosis include alfacalcidol, calcitriol, elcatonin, calcitonin salmon, estriol, ipriflavone, pamidronate disodium, alendronate sodium hydrate, incadronate disodium, risedronate disodium and the like.

Examples of the vitamin include vitamin $B_1$, vitamin $B_{12}$ and the like.

Examples of the antidementia drug include tacrine, donepezil, rivastigmine, galanthamine and the like.

Examples of the erectile dysfunction drug include apomorphine, sildenafil citrate and the like.

Examples of the therapeutic drug for urinary frequency or urinary incontinence include flavoxate hydrochloride, oxybutynin hydrochloride, propiverine hydrochloride and the like.

Examples of the therapeutic agent for dysuria include acetylcholine esterase inhibitors (e.g., distigmine) and the like.

Examples of the central D2 receptor antagonist include typical psychotropic drugs (prochlorperazine, haloperidol, chlorpromazine, and the like), serotonin dopamine antagonists (perospirone, risperidone, and the like), and multi-acting receptor targeted antipsychotic drugs (olanzapine and the like).

Examples of the prokinetic agent include peripheral D2 receptor antagonists (metoclopramide, domperidone, and the like) and 5HT4 receptor agonists (mosapride and the like).

Examples of the antihistamine include hydroxyzine, diphenhydramine, and chlorpheniramine.

Examples of the muscarinic receptor antagonist include central muscarinic receptor antagonists (scopolamine and the like) and peripheral muscarinic receptor antagonists (butylscopolamine and the like).

Examples of the serotonin 5HT3 receptor antagonist include granisetron, ondansetron, azasetron, indisetron, palonosetron, and ramosetron.

Examples of the somatostatin analogue include octreotide.

Examples of the corticosteroid include dexamethasone, betamethasone, and methylprednisolone.

Examples of the benzodiazepine anxiolytic include lorazepam and alprazolam, examples of the NK-1 receptor antagonist include aprepitant and fosaprepitant, and examples of the hypercalcemia therapeutic drug include bisphosphonate.

Moreover, a drug confirmed to have a cachexia-ameliorating action either in animal models or clinically, i.e., a cyclooxygenase inhibitor (e.g., indomethacin), a progesterone derivative (e.g., megestrol acetate), glucocorticoid (e.g., dexamethasone), a metoclopramide drug, a tetrahydrocannabinol drug, an agent for improving fat metabolism (e.g., eicosapentaenoic acid), growth hormone, IGF-1, or an antibody against a cachexia-inducing factor TNF-α, LIF, IL-6 or oncostatin M or the like can also be used in combination with the compound of the present disclosure.

Alternatively, a glycation inhibitor (e.g., ALT-711), a nerve regeneration-promoting drug (e.g., Y-128, VX853, prosaptide), an antidepressant (e.g., desipramine, amitriptyline, imipramine), an antiepileptic drug (e.g., lamotrigine, Trileptal, Keppra, Zonegran, Pregabalin, Harkoseride, carbamazepine), an antiarrhythmic drug (e.g., mexiletine), an acetylcholine receptor ligand (e.g., ABT-594), an endothelin receptor antagonist (e.g., ABT-627), a monoamine uptake inhibitor (e.g., tramadol), a narcotic analgesic (e.g., morphine), a GABA receptor agonist (e.g., gabapentin, MR preparation of gabapentin), an α2 receptor agonist (e.g., clonidine), a local analgesic (e.g., capsaicin), an antianxiety drug (e.g., benzothiazepine), a phosphodiesterase inhibitor (e.g., sildenafil), a dopamine receptor agonist (e.g., apomorphine), midazolam, ketoconazole or the like may be used in combination with the compound of the present disclosure.

The time of administration of the GIP receptor agonist peptide of the present disclosure and that of the concomitant drug are not limited, and they may be administered simultaneously or in a staggered manner to the administration subject.

Examples of such administration mode include the following:

(1) administration of a single preparation obtained by simultaneously processing the GIP receptor agonist peptide of the present disclosure and the concomitant drug, (2) simultaneous administration of two kinds of preparations of the GIP receptor agonist peptide of the present disclosure and the concomitant drug, which have been separately produced by the same administration route, (3) administration of two kinds of preparations of the GIP receptor agonist peptide of the present disclosure and the concomitant drug, which have been separately produced, by the same administration route in a staggered manner, (4) simultaneous administration of two kinds of preparations of the GIP receptor agonist peptide of the present disclosure and the concomitant drug, which have been separately produced, by different administration routes, (5) administration of two kinds of preparations of the compound of the present disclosure and the concomitant drug, which have been separately produced, by different administration routes in a staggered manner (e.g., administration in the order of the GIP receptor agonist peptide of the present disclosure and the concomitant drug, or in the reverse order) and the like.

The dose of the concomitant drug can be appropriately determined based on the dose employed in clinical situations. The mixing ratio of the GIP receptor agonist peptide of the present disclosure and a concomitant drug can be appropriately determined depending on the administration subject, symptom, administration method, target disease, combination and the like. When the subject of administration is human, for example, a concomitant drug can be used in 0.01-100 parts by weight relative to 1 part by weight of the GIP receptor agonist peptide of the present disclosure.

By combining the GIP receptor agonist peptide of the present disclosure and concomitant drug:

(1) the dose of the GIP receptor agonist peptide of the present disclosure or a concomitant drug can be reduced as compared to single administration of the GIP receptor agonist peptide of the present disclosure or a concomitant drug, (2) the drug to be used in combination with the GIP receptor agonist peptide of the present disclosure can be selected depending on the condition of patients (mild, severe and the like), (3) the period of treatment can be set longer by selecting a concomitant drug having different action and mechanism from those of the GIP receptor agonist peptide of the present disclosure, (4) a sustained treatment effect can be designed by selecting a concomitant drug having different action and mechanism from those of the GIP receptor agonist peptide of the present disclosure, and (5) a synergistic effect can be afforded by a combined use of the GIP receptor agonist peptide of the present disclosure and a concomitant drug, and the like, can be achieved.

F. EXAMPLES

The abbreviations used in the present specification mean the following (Table 1). A hyphen in terms such as α-MePhe and the like as described herein may be omitted, and the event of omission also represents the same meaning.

In the amino acid sequences used in the present specification, the left terminal represents N terminal and the right terminal represents C terminal.

TABLE 1
Commonly used abbreviations in the present disclosure.
| | |
|---|---|
| Ac | acetyl |
| Aib | α-aminoisobutyric acid |
| Ambz (4) | 4-aminomethylbenzoyl |
| GABA | γ-aminobutyric acid |
| Iva | isovaline |
| Lys (Ac) | Nε-methylphenylalanine |
| α-MePhe | α-methylphenylalanine |
| MeTyr | N-Methyltyrosine |
| Hda | 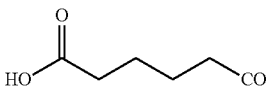 |
| Doda | 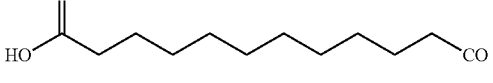 |
| Trda | 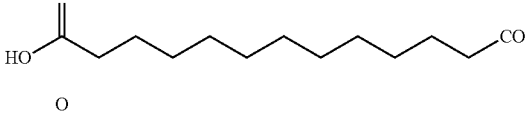 |
| Teda | 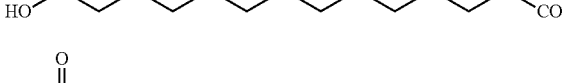 |
| Peda | 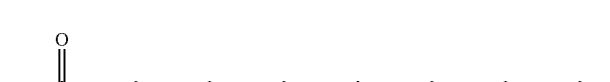 |
| Heda | 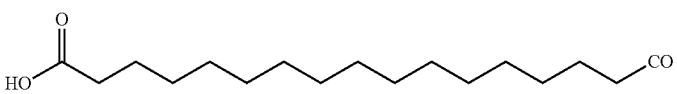 |
| Hepda | 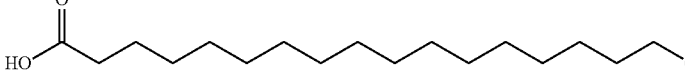 |
| Oda | 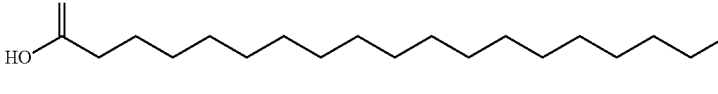 |
| Eda | 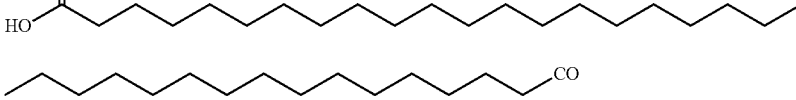 |
| Dda | 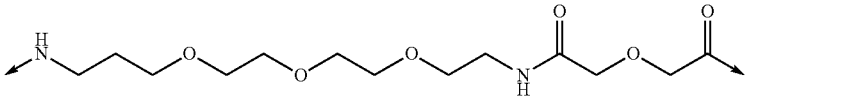 |
| Pal | |
| PEG (2) |  |

TABLE 1-continued
Commonly used abbreviations in the present disclosure.
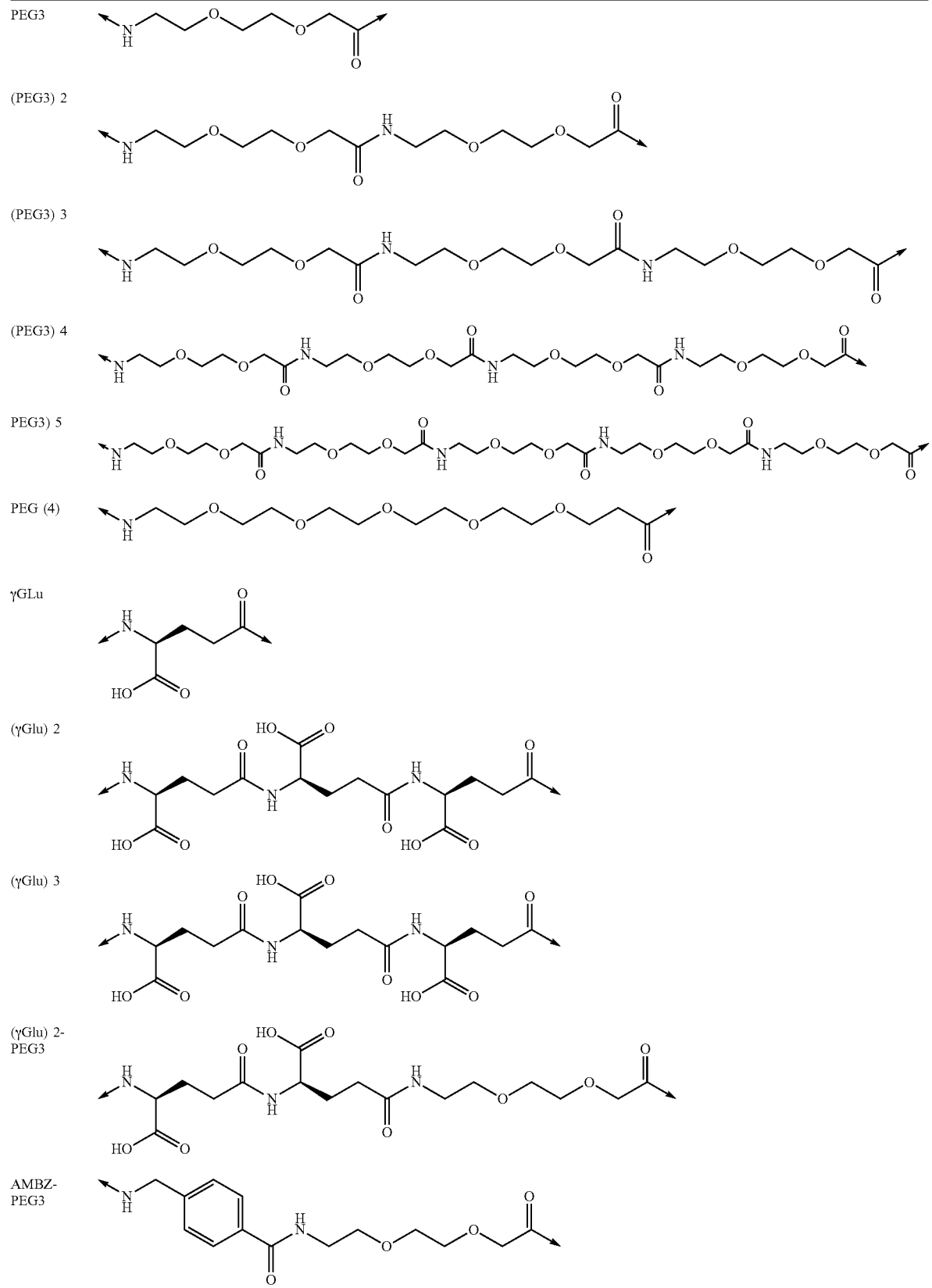

TABLE 1-continued

Commonly used abbreviations in the present disclosure.

| Abbreviation | Structure |
|---|---|
| GABA-(PEG3) 2 | (structure) |
| GG | (structure) |
| GGG | (structure) |
| GGGG (SEQ ID NO: 283) | (structure) |
| GGGGG (SEQ ID NO: 284) | (structure) |
| GGGGGG (SEQ ID NO: 285) | (structure) |
| G9 (SEQ ID NO: 288) | (structure) |
| NpipAc | (structure) |
| NpipAc-PEG3 | (structure) |
| Tra | (structure) |
| Tra-GGG | (structure) |

TABLE 1-continued
Commonly used abbreviations in the present disclosure.
Tra-PEG3
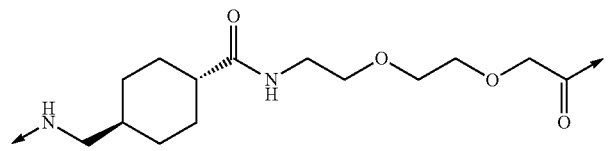
γGlu-PEG3
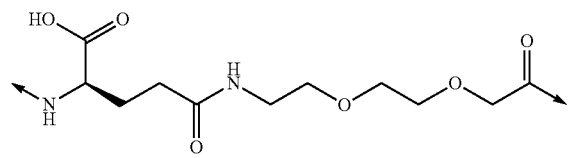
γGlu-(PEG3)2
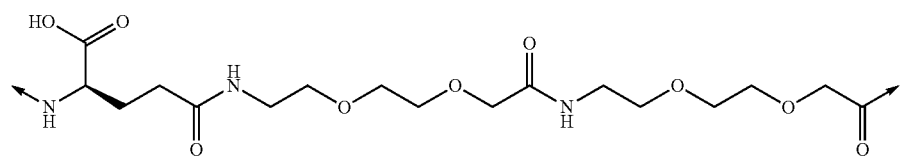
γGlu-PEG3
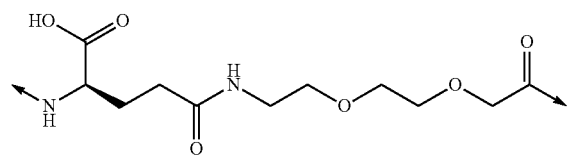
γGlu-(PEG3)2
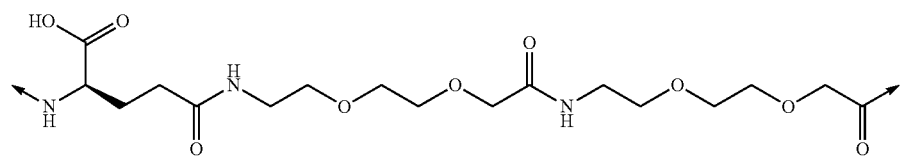
γGlu-AMBZ-PEG3
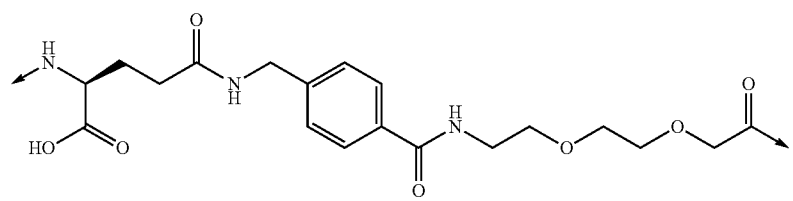
γGlu-GGG
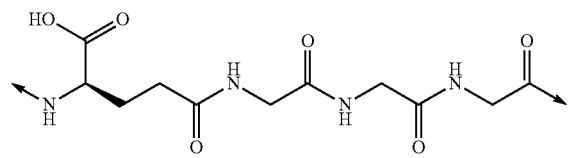
εLys
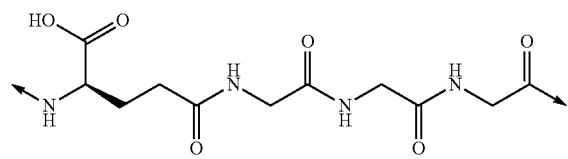
εLys-GGG
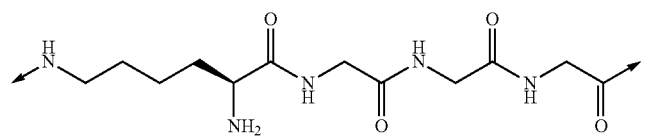

TABLE 1-continued

Commonly used abbreviations in the present disclosure.

εLys-PEG3

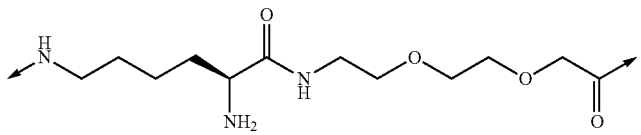

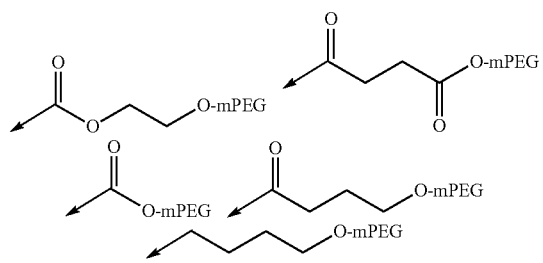

PEG linkers used for Cys. PEG=5-30 kDa PEG

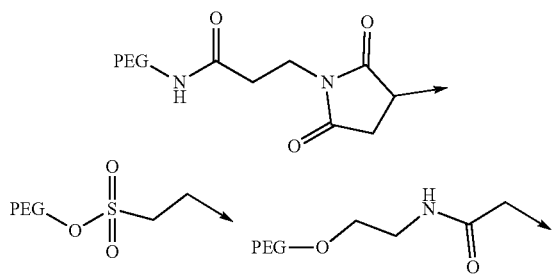

In the specification, where bases, amino acids, etc. are denoted by their codes, they are based on conventional codes in accordance with the IUPAC-IUB Commission on Biochemical Nomenclature or by the common codes in the art, examples of which are shown below. For amino acids that may have an optical isomer, L-form is presented unless otherwise indicated (e.g., "Ala" is L-form of Ala). In addition, "D-" means a D-form (e.g., "D-Ala" is D-form of Ala), and "DL-" means a racemate of a D-form and an L-form (e.g., "DL-Ala" is DL racemate of Ala).

The present disclosure is explained in detail in the following by referring to the following Reference Examples, Examples, Test Examples and Formulation Examples, which are mere embodiments and not to be construed as limitative. In addition, the present disclosure may be modified without departing from the scope of invention.

The term "room temperature" in the following Examples indicates the range of generally from about 10° C. to about 35° C. As for "%", the yield is in mol/mol %, the solvent used for chromatography is in % by volume and other "%" is in % by weight.

NMP: methylpyrrolidone
THF: tetrahydrofuran
DMF: N,N-dimethylformamide
WSC: 1-(3-dimethylaminopropyl)-3-ethylcarbodiimide hydrochloride
DCC: N,N'-Dicyclohexylcarbodiimide
DIPCDI: N,N'-diisopropylcarbodiimide
HOBt: 1-hydroxybenzotriazole monohydrate Oxyma: ethyl 2-cyano-2-(hydroxyimino)acetate Example 1. Synthesis Schemes Exemplary methods for synthesizing GIP receptor agonist peptides are disclosed for example in Applicant's International PCT Application No. PCT/JP2018/013540, filed on Mar. 30, 2018, ranging from pages 162 to 213, the disclosure of which is specifically incorporated herein by reference in its entirety.

Synthesis of Illustrative GIP Receptor Agonist Peptides of the Present Disclosure Example 2. Synthesis of Exemplary Synthesis of Illustrative Selective GIP Receptor Agonist Peptides of the Present Disclosure. Compound No. 7; SEQ ID NO: 18

Step 1

Synthesis of Boc-Tyr(tBu)-Aib-Glu(OtBu)-Gly-Thr(tBu)-Val-Val-Ser(tBu)-Leu-Tyr(tBu)-Ser(tBu)-Ile-Aib-Leu-Asp(OtBu)-Lys(boc)-Gln(Trt)-Ala-Gln(Trt)-Aib-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys (SEQ ID NO: 322) Sieber Amide Resin (Compound 7-Intermediate)

Sieber amide resin (0.71 meq/g, 140.8 mg, 0.1 mmol) was added to a reaction tube, which was then set in a Automated Microwave Peptide synthesizer (CEM Liberty blue), and amino acids were sequentially extended according to the protocol using 20% piperidine/DMP (reacted at 90° C. for 1 minute) to deprotect the Fmoc group and 5 equivalents of Fmoc-amino acids/DIPCDI/Oxyma [reacted at 90° C. for 2 minutes] to condense the Fmoc-amino acids. The condensation of Ile at position at 12, Leu at position 9, Val at position 6 and Thr(tBu) at position 5 were carried out by double coupling method. After the termination of condensation, the resin was washed with MeOH, and dried under reduced pressure to give Boc-Tyr(tBu)-Aib-Glu(OtBu)-Gly-Thr(tBu)-Val-Val-Ser(tBu)-Leu-Tyr(tBu)-Ser(tBu)-Ile-Aib-Leu-Asp(OtBu)-Lys(boc)-Gln(Trt)-Ala-Gln(Trt)-Aib-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys(Alloc) SEQ ID NO: 323) Sieber amide resin. To the dried resin was added tetrakis(triphenylphosphine)palladium(0)(288.9 mg, 0.25 mmol) in 4.0 mL of toluene: AcOH: 4-Methylmorpholine (37:2:1). The mixture was shaken for 16 hours (overnight) under Ar at room temperature. The reaction solution was filtered off. The resin was then washed with toluene, 0.5% wt sodium N,N-diethyldithiocarbamate trihydrate/NMP, DIEA/NMP, NMP and MeOH, and dried under reduced pressure. As a result, 470.1 mg (0.213 meq/g) of the protected peptide resin of interest was obtained.

Step 2

Synthesis of Tyr-Aib-Glu-Gly-Thr-Val-Val-Ser-Leu-Tyr-Ser-Ile-Aib-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys(Heda-Gly-Gly-Gly-Gly-) (SEQ ID NO: 18) (Compound 7)

Boc-Tyr(tBu)-Aib-Glu(OtBu)-Gly-Thr(tBu)-Val-Val-Ser(tBu)-Leu-Tyr(tBu)-Ser(tBu)-Ile-Aib-Leu-Asp(OtBu)-Lys(boc)-Gln(Trt)-Ala-Gln(Trt)-Aib-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys-Sieber amide resin (SEQ ID NO: 322) (40.6 mg, 0.01 mmol) synthesized in step 1 was weighed into a reaction tube, and swollen with NMP. After removal of NMP by filtration, Fmoc-Gly-OH (14.9 mg), 0.5 M Oxyma in NMP (100 μL) and diisopropylcarbodiimide (8.0 μL) were successively added to the resin, and then the mixture was shaken overnight. The reaction solution was filtered off, and the resin was then washed with NMP 10 times. Fmoc-Gly-OH (14.9 mg), 0.5 M Oxyma in NMP (100 μL) and diisopropylcarbodiimide (8.0 μL) was then added thereto again, and the mixture was shaken for 4.5 hours After confirmation of negativity in the Ninhydrin test, a NMP solution of 20% piperidine was added thereto, and the mixture was shaken for 1 minute. The solution was filtered off, and a NMP solution of 20% piperidine was then added thereto again, and the mixture was shaken for 20 minutes. The solution was filtered off, and the resin was then washed with NMP 10 times. This Fmoc amino acid condensation (double coupling)-Fmoc deprotection cycle was repeated to successively condense Gly, Gly, Gly* and Heda(OtBu)** (*: overnight single coupling, **: 10 equivalents of Heda(OtBu)/DIPCDI/Oxyma). The resin was washed with MeOH, and dried under reduced pressure to thereby obtain 41.4 mg of the protected peptide resin of interest, Boc-Tyr(tBu)-Aib-Glu(OtBu)-Gly-Thr(tBu)-Val-Val-Ser(tBu)-Leu-Tyr(tBu)-Ser(tBu)-Ile-Aib-Leu-Asp(OtBu)-Lys(Boc)-Gln(Trt)-Ala-Gln(Trt)-Aib-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys(Heda(OtBu)-Gly-Gly-Gly-Gly-) (SEQ ID NO: 324) Sieber amide resin. To the total amount of the obtained resin, 0.5 mL of TFA:m-cresol:thioanisole:ethanedithiol:H₂O:triisopropylsilane (80:5:5:5:2.5:2.5) was added and the resulting mixture was stirred for 1.5 hours. Diethyl ether was added to the reaction solution to obtain a precipitate and after centrifugation the supernatant was removed. Diethyl ether was added to the precipitate and after centrifugation the supernatant was removed. This operation was repeated twice. The residue was extracted with a 50% acetic acid aqueous solution and the resin was removed by filtration, and then the purification was carried out by preparative HPLC using Phenomenex Kinetex XB-C18 100A (250×21.1 mm I.D.), by the linear concentration gradient elution (60 minutes) with solution A: 0.1% TFA-water and solution B: 0.1% TFA-containing acetonitrile at a flow rate of 8 mL/minute from A/B: 63/37 to 53/47, and fractions containing the product of interest were collected and freeze-dried to thereby obtain 1.0 mg of a white powder.

Mass spectrometry result: (M+H)+ 4727.46 (calculated 4727.57).

HPLC elution time: 15.23 minutes

Elution Conditions:

Column: Kinetex XB-C18 100A (4.6×100 mm I.D.)

Eluents: Using solution A: 0.1% TFA-water, solution B: 0.1% TFA-containing acetonitrile, A/B: 80/20 to 30/70. Linear concentration gradient elution (25 minutes).

Flow rate: 1.0 mL/minutes

Temperature: Room temperature

Example 2. Synthesis of Exemplary Synthesis of Illustrative GIP Receptor Agonist Peptides of the Present Disclosure. Synthesis of Compound 60; SEQ ID NO:71

Step 1

Synthesis of Boc-MeTyr(tBu)-Aib-Glu(OtBu)-Gly-Thr(tBu)-Phe-Ile-Ser(tBu)-Asp(OtBu)-Tyr(tBu)-Ser(tBu)-Ile-Ala-Leu-Asp(OtBu)-Arg(Pbf)-Aib-His(Trt)-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Lys (SEQ ID NO: 325) Sieber Amide Resin. (Compound 7-Intermediate)

Sieber amide resin (0.71 meq/g, 70.4 mg, 0.05 mmol) was added to a reaction tube, which was then set in a peptide synthesizer, and amino acids were sequentially extended according to the protocol using 20% piperidine/NMP [reacted at 50° C. for 5 minutes] to deprotect the Fmoc group and 5 equivalents of Fmoc-amino acids/DIPCDI/Oxyma [reacted at 50° C. for 15 minutes] to condense the Fmoc-amino acids. In this case, the condensation reaction of Boc-MeTyr(tBu) at position 1, Thr(tBu) at position 5, Ile at position 12, Arg(Pbf) at position 16, Gln(Trt) at position 19, Trp(Boc) at position 25, Leu at position 27 and Lys(ivDde) at position 40 were carried out at 50° C. for 30 minutes.

The operation wherein the obtained Boc-MeTyr(tBu)-Aib-Glu(OtBu)-Gly-Thr(tBu)-Phe-Ile-Ser(tBu)-Asp(OtBu)-Tyr(tBu)-Ser(tBu)-Ile-Ala-Leu-Asp(OtBu)-Arg(Pbf)-Aib-His(Trt)-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Lys(ivDde) (SEQ ID NO: 326) Sieber amide resin was suspended in a 2% hydrazine/NMP solution, the resulting suspension was stirred at 50° C. for 10 minutes, and then the solution was removed by filtration.

This procedure was repeated 4 times to deprotect the ivDde group of Lys at position 40.

The obtained resin was washed with MeOH, and dried under reduced pressure to thereby obtain 373.4 mg of Boc-MeTyr(tBu)-Aib-Glu(OtBu)-Gly-Thr(tBu)-Phe-Ile-Ser(tBu)-Asp(OtBu)-Tyr(tBu)-Ser(tBu)-Ile-Ala-Leu-Asp(OtBu)-Arg(Pbf)-Aib-His(Trt)-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Lys (SEQ ID NO: 325) Sieber amide resin.

Step 2

Synthesis of Boc-MeTyr(tBu)-Aib-Glu(OtBu)-Gly-Thr(tBu)-Phe-Ile-Ser(tBu)-Asp(OtBu)-Tyr(tBu)-Ser(tBu)-Ile-Ala-Leu-Asp(OtBu)-Arg(Pbf)-Aib-His(Trt)-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Lys(Oda-GlyGlyGlyGlyGly). (SEQ ID NO: 71) (Compound 60).

Boc-MeTyr(tBu)-Aib-Glu(OtBu)-Gly-Thr(tBu)-Phe-Ile-Ser(tBu)-Asp(OtBu)-Tyr(tBu)-Ser(tBu)-Ile-Ala-Leu-Asp(OtBu)-Arg(Pbf)-Aib-His(Trt)-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Lys (SEQ ID NO: 325) Sieber amide resin (74 mg, 0.01 mmol) synthesized in Step 1 was weighed into a reaction tube, which was then set in a peptide synthesizer, and amino acids were sequentially extended according to the protocol using 20% piperidine/NMP [reacted at 50° C. for 5 minutes] to deprotect the Fmoc group and 5 equivalents of Fmoc-amino acids/DIPCDI/Oxyma [reacted at 50° C. for 15 minutes] to condense the Fmoc-amino acids. For introduction of Fmoc-GlyGlyGly-OH, Fmoc-GlyGly-OH, Fmoc-Gly-OtBu, the coupling reaction was repeated twice. For Oda, the reation was conducted for 30 minutes.

The resulting resin was washed with MeOH, and dried under reduced pressure to thereby obtain 79.4 mg of the protected peptide resin of interest, Boc-MeTyr(tBu)-Aib-Glu(OtBu)-Gly-Thr(tBu)-Phe-Ile-Ser(tBu)-Asp(OtBu)-Tyr(tBu)-Ser(tBu)-Ile-Ala-Leu-Asp(OtBu)-Arg(Pbf)-Aib-His(Trt)-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Lys(Oda-GlyGlyGlyGlyGly) (SEQ ID NO: 327) Sieber amide resin.

To the total amount of the obtained resin, 0.8 mL of TFA:m-cresol:thioanisole:ethanedithiol:$H_2O$:triisopropylsilane (80:5:5:5:2.5:2.5) was added and the resulting mixture was stirred for 1.5 hours. Diethyl ether was added to the reaction solution to obtain a precipitate and after centrifugation the supernatant was removed. Diethyl ether was added to the precipitate and after centrifugation the supernatant was removed. This operation was repeated twice. The residue was extracted with a 90% acetic acid aqueous solution and the resin was removed by filtration, and then the purification was carried out by preparative HPLC using YMC-Actus Triart C8 (250×20 mm I.D.), by the linear concentration gradient elution (60 minutes) with solution A: 0.1% TFA-water and solution B: 0.1% TFA-containing acetonitrile at a flow rate of 8 mL/minute from A/B: 59/41 to 49/51, and fractions containing the product of interest were collected and freeze-dried to thereby obtain 8.2 mg of a white powder.

Mass spectrometry result: (M+H)+ 5127.07 (calculated 5126.64).

HPLC elution time: 5.62 minutes

Elution Conditions:
  Column: Kinetex 1.7 μm C8 100A (100×2.1 mm I.D.)
  Eluents: Using solution A: 0.1% TFA-water, solution B: 0.1% TFA-containing acetonitrile, A/B: 80/20 to 30/70. Linear concentration gradient elution (10 minutes).
  Flow rate: 0.5 mL/minutes
  Temperature: 40 degree Subsequently, the total amount of the obtained powder was dissolved in 50% acetonitrile-water, an ion exchange resin [AG 1X8 resin (acetate form), 1.2 meq/mL, 20 μL] was added to the solution, and the resulting mixture was shaken for 1 hour. After removal of the resin by filtration, the filtrate was freeze-dried to thereby obtain 6.9 mg of the acetate of the product of interest.

Mass spectrometry result: (M+H)+ 5128.06 (calculated 5126.64).

HPLC elution time: 5.58 minutes

Elution Conditions:
  Column: Kinetex 1.7 μm C8 100A, (100×2.1 mm I.D.)
  Eluents: Using solution A: 0.1% TFA-water, solution B: 0.1% TFA-containing acetonitrile, A/B: 80/20 to 30/70. Linear concentration gradient elution (10 minutes).
  Flow rate: 0.5 mL/minutes
  Temperature: 40° C.

TABLE 2

Characterization of the exemplified GIP receptor agonist peptides of the present disclosure.

| SEQ ID NO. | Compound No. | Mass obs. | Mass calc. | HPLC retention time (min) | HPLC conditions (Column)$^a$ | HPLC gradient A/B (A: 0.1% TFA-water: B: 0.1% TFA-acetonitrile) | HPLC gradient time (min) | HPLC Flow rate (mL/min) | HPLC Temp: ° C. |
|---|---|---|---|---|---|---|---|---|---|
| 12 | 1 | 4555.2 | 4555.5 | 18.94 | A | 80/20 to 30/70 | 25 | 1 | RT |
| 13 | 2 | 4873.4 | 4873.7 | 18.83 | A | 80/20 to 30/70 | 25 | 1 | RT |
| 14 | 3 | 4817.5 | 4817.7 | 16.78 | B | 80/20 to 30/70 | 25 | 1 | RT |
| 15 | 4 | 4845.6 | 4845.7 | 17.75 | B | 80/20 to 30/70 | 25 | 1 | RT |
| 16 | 5 | 4876.4 | 4876.7 | 15.30 | B | 80/20 to 30/70 | 25 | 1 | RT |
| 17 | 6 | 4932.5 | 4932.7 | 17.65 | B | 80/20 to 30/70 | 25 | 1 | RT |
| 18 | 7 | 4727.5 | 4727.6 | 15.23 | B | 80/20 to 30/70 | 25 | 1 | RT |
| 19 | 8 | 4812.8 | 4812.7 | 18.94 | B | 80/20 to 30/70 | 25 | 1 | RT |
| 20 | 9 | 4500.0 | 4499.5 | 15.90 | B | 80/20 to 30/70 | 25 | 1 | RT |
| 21 | 10 | 4527.8 | 4528.5 | 17.39 | B | 80/20 to 30/70 | 25 | 1 | RT |
| 22 | 11 | 4558.8 | 4558.5 | 14.58 | B | 80/20 to 30/70 | 25 | 1 | RT |
| 23 | 12 | 4674.5 | 4674.4 | 17.16 | B | 80/20 to 30/70 | 25 | 1 | RT |
| 24 | 13 | 4760.7 | 4760.5 | 16.11 | B | 80/20 to 30/70 | 25 | 1 | RT |
| 25 | 14 | 4992.8 | 4992.6 | 17.48 | B | 80/20 to 30/70 | 25 | 1 | RT |
| 26 | 15 | 4902.2 | 4902.5 | 16.50 | B | 80/20 to 30/70 | 25 | 1 | RT |
| 27 | 16 | 4803.2 | 4803.5 | 16.71 | B | 80/20 to 30/70 | 25 | 1 | RT |
| 28 | 17 | 4684.6 | 4684.6 | 18.57 | B | 80/20 to 30/70 | 25 | 1 | RT |
| 29 | 18 | 4657.6 | 4657.6 | 17.17 | B | 80/20 to 30/70 | 25 | 1 | RT |
| 30 | 19 | 4743.8 | 4743.6 | 16.34 | C | 80/20 to 30/70 | 25 | 1 | RT |
| 31 | 20 | 4094.5 | 4095.4 | 10.04 | C | 95/5 to 5/95 | 15 | 3 | RT |
| 32 | 21 | 5103.7 | 5103.6 | 5.37 | D | 80/20 to 30/70 | 10 | 0.5 | 40 |
| 33 | 22 | 5131.6 | 5131.7 | 5.78 | D | 80/20 to 30/70 | 10 | 0.5 | 40 |
| 34 | 23 | 5159.6 | 5159.7 | 6.27 | D | 80/20 to 30/70 | 10 | 0.5 | 40 |
| 35 | 24 | 5155.5 | 5155.6 | 5.19 | D | 80/20 to 30/70 | 10 | 0.5 | 40 |
| 36 | 25 | 5339.9 | 5339.8 | 5.49 | D | 80/20 to 30/70 | 10 | 0.5 | 40 |
| 37 | 26 | 5367.8 | 5367.8 | 5.96 | D | 80/20 to 30/70 | 10 | 0.5 | 40 |
| 38 | 27 | 5003.5 | 5003.6 | 6.13 | D | 80/20 to 30/70 | 10 | 0.5 | 40 |
| 39 | 28 | 5031.8 | 5031.7 | 6.52 | D | 80/20 to 30/70 | 10 | 0.5 | 40 |
| 40 | 29 | 5059.8 | 5059.7 | 6.93 | D | 80/20 to 30/70 | 10 | 0.5 | 40 |
| 41 | 30 | 5055.4 | 5055.6 | 5.97 | D | 80/20 to 30/70 | 10 | 0.5 | 40 |
| 42 | 31 | 5240.1 | 5239.8 | 6.25 | D | 80/20 to 30/70 | 10 | 0.5 | 40 |
| 43 | 32 | 5268.2 | 5267.8 | 6.64 | D | 80/20 to 30/70 | 10 | 0.5 | 40 |

TABLE 2-continued

Characterization of the exemplified GIP receptor agonist peptides of the present disclosure.

| SEQ ID NO. | Compound No. | Mass obs. | Mass calc. | HPLC retention time (min) | HPLC conditions (Column)[a] | HPLC gradient A/B (A: 0.1% TFA-water: B: 0.1% TFA-acetonitrile) | HPLC gradient time (min) | HPLC Flow rate (mL/min) | HPLC Temp: °C.) |
|---|---|---|---|---|---|---|---|---|---|
| 44 | 33 | 5055.0 | 5054.7 | 6.77 | D | 80/20 to 30/70 | 10 | 0.5 | 40 |
| 45 | 34 | 5211.7 | 5211.7 | 6.08 | D | 80/20 to 30/70 | 10 | 0.5 | 40 |
| 46 | 35 | 5114.0 | 5114.8 | 7.09 | D | 80/20 to 30/70 | 10 | 0.5 | 40 |
| 47 | 36 | 5214.1 | 5214.8 | 6.43 | D | 80/20 to 30/70 | 10 | 0.5 | 40 |
| 48 | 37 | 4958.7 | 4958.7 | 7.29 | D | 80/20 to 30/70 | 10 | 0.5 | 40 |
| 49 | 38 | 5058.7 | 5058.7 | 6.64 | D | 80/20 to 30/70 | 10 | 0.5 | 40 |
| 50 | 39 | 5086.1 | 5086.8 | 6.68 | D | 80/20 to 30/70 | 10 | 0.5 | 40 |
| 51 | 40 | 5186.9 | 5186.8 | 5.95 | D | 80/20 to 30/70 | 10 | 0.5 | 40 |
| 52 | 41 | 4930.7 | 4930.7 | 6.82 | D | 80/20 to 30/70 | 10 | 0.5 | 40 |
| 53 | 42 | 5030.0 | 5030.7 | 6.10 | D | 80/20 to 30/70 | 10 | 0.5 | 40 |
| 54 | 43 | 5058.1 | 5058.7 | 6.26 | D | 80/20 to 30/70 | 10 | 0.5 | 40 |
| 55 | 44 | 5158.1 | 5158.7 | 5.49 | D | 80/20 to 30/70 | 10 | 0.5 | 40 |
| 56 | 45 | 4902.2 | 4902.6 | 6.39 | D | 80/20 to 30/70 | 10 | 0.5 | 40 |
| 57 | 46 | 5002.3 | 5002.6 | 5.62 | D | 80/20 to 30/70 | 10 | 0.5 | 40 |
| 58 | 47 | 5138.4 | 5138.7 | 6.68 | D | 80/20 to 30/70 | 10 | 0.5 | 40 |
| 59 | 48 | 5238.4 | 5238.7 | 5.98 | D | 80/20 to 30/70 | 10 | 0.5 | 40 |
| 60 | 49 | 4982.3 | 4982.6 | 6.82 | D | 80/20 to 30/70 | 10 | 0.5 | 40 |
| 61 | 50 | 5082.4 | 5082.6 | 6.12 | D | 80/20 to 30/70 | 10 | 0.5 | 40 |
| 62 | 51 | 5110.2 | 5110.7 | 6.27 | D | 80/20 to 30/70 | 10 | 0.5 | 40 |
| 63 | 52 | 5210.1 | 5210.7 | 5.52 | D | 80/20 to 30/70 | 10 | 0.5 | 40 |
| 64 | 53 | 4954.2 | 4954.6 | 6.40 | D | 80/20 to 30/70 | 10 | 0.5 | 40 |
| 65 | 54 | 5054.0 | 5054.6 | 5.64 | D | 80/20 to 30/70 | 10 | 0.5 | 40 |
| 66 | 55 | 5082.1 | 5082.7 | 5.91 | D | 80/20 to 30/70 | 10 | 0.5 | 40 |
| 67 | 56 | 5182.0 | 5182.7 | 5.10 | D | 80/20 to 30/70 | 10 | 0.5 | 40 |
| 68 | 57 | 4926.0 | 4926.6 | 6.02 | D | 80/20 to 30/70 | 10 | 0.5 | 40 |
| 69 | 58 | 5026.0 | 5026.6 | 5.20 | D | 80/20 to 30/70 | 10 | 0.5 | 40 |
| 70 | 59 | 5098.8 | 5098.6 | 5.2 | D | 80/20 to 30/70 | 10 | 0.5 | 40 |
| 71 | 60 | 5127.1 | 5126.6 | 5.62 | D | 80/20 to 30/70 | 10 | 0.5 | 40 |
| 72 | 61 | 5155.0 | 5154.7 | 6.09 | D | 80/20 to 30/70 | 10 | 0.5 | 40 |
| 73 | 62 | 4998.9 | 4998.6 | 6 | D | 80/20 to 30/70 | 10 | 0.5 | 40 |
| 74 | 63 | 5027.2 | 5026.6 | 6.37 | D | 80/20 to 30/70 | 10 | 0.5 | 40 |
| 75 | 64 | 5260.2 | 5259.8 | 5.19 | D | 80/20 to 30/70 | 10 | 0.5 | 40 |
| 76 | 65 | 5288.0 | 5287.8 | 5.61 | D | 80/20 to 30/70 | 10 | 0.5 | 40 |
| 77 | 66 | 5316.1 | 5315.8 | 6.06 | D | 80/20 to 30/70 | 10 | 0.5 | 40 |
| 78 | 67 | 5160.2 | 5159.7 | 5.98 | D | 80/20 to 30/70 | 10 | 0.5 | 40 |
| 79 | 68 | 5187.8 | 5187.8 | 6.36 | D | 80/20 to 30/70 | 10 | 0.5 | 40 |
| 80 | 69 | 5215.8 | 5215.8 | 6.73 | D | 80/20 to 30/70 | 10 | 0.5 | 40 |
| 81 | 70 | 5254.9 | 5254.7 | 5.05 | D | 80/20 to 30/70 | 10 | 0.5 | 40 |
| 82 | 71 | 5283.0 | 5282.7 | 5.48 | D | 80/20 to 30/70 | 10 | 0.5 | 40 |
| 83 | 72 | 5311.1 | 5310.8 | 5.93 | D | 80/20 to 30/70 | 10 | 0.5 | 40 |
| 84 | 73 | 5155.3 | 5154.7 | 5.88 | D | 80/20 to 30/70 | 10 | 0.5 | 40 |
| 85 | 74 | 5183.3 | 5182.7 | 6.23 | D | 80/20 to 30/70 | 10 | 0.5 | 40 |
| 86 | 75 | 5211.4 | 5210.8 | 6.62 | D | 80/20 to 30/70 | 10 | 0.5 | 40 |
| 87 | 76 | 5310.3 | 5309.8 | 7.41 | D | 80/20 to 30/70 | 10 | 0.5 | 40 |
| 88 | 77 | 5410.4 | 5409.8 | 7.18 | D | 80/20 to 30/70 | 10 | 0.5 | 40 |
| 89 | 78 | 5041.7 | 5041.7 | 6.66 | D | 80/20 to 30/70 | 10 | 0.5 | 40 |
| 90 | 79 | 5051.7 | 5051.7 | 6.75 | D | 80/20 to 30/70 | 10 | 0.5 | 40 |
| 91 | 80 | 5051.6 | 5051.7 | 6.72 | D | 80/20 to 30/70 | 10 | 0.5 | 40 |
| 92 | 81 | 5081.7 | 5081.7 | 6.71 | D | 80/20 to 30/70 | 10 | 0.5 | 40 |
| 93 | 82 | 5067.9 | 5067.7 | 6.70 | D | 80/20 to 30/70 | 10 | 0.5 | 40 |
| 94 | 83 | 5041.7 | 5041.7 | 6.71 | D | 80/20 to 30/70 | 10 | 0.5 | 40 |
| 95 | 84 | 5041.9 | 5041.7 | 6.70 | D | 80/20 to 30/70 | 10 | 0.5 | 40 |
| 96 | 85 | 5041.9 | 5041.7 | 6.70 | D | 80/20 to 30/70 | 10 | 0.5 | 40 |
| 97 | 86 | 5052.0 | 5051.7 | 6.68 | D | 80/20 to 30/70 | 10 | 0.5 | 40 |
| 98 | 87 | 5014.0 | 5013.7 | 6.30 | D | 80/20 to 30/70 | 10 | 0.5 | 40 |
| 99 | 88 | 5024.0 | 5023.7 | 6.38 | D | 80/20 to 30/70 | 10 | 0.5 | 40 |
| 100 | 89 | 5024.0 | 5023.7 | 6.35 | D | 80/20 to 30/70 | 10 | 0.5 | 40 |
| 101 | 90 | 5054.1 | 5053.7 | 6.36 | D | 80/20 to 30/70 | 10 | 0.5 | 40 |
| 102 | 91 | 5040.1 | 5039.7 | 6.33 | D | 80/20 to 30/70 | 10 | 0.5 | 40 |
| 103 | 92 | 5014.1 | 5013.7 | 6.35 | D | 80/20 to 30/70 | 10 | 0.5 | 40 |
| 104 | 93 | 5014.1 | 5013.7 | 6.33 | D | 80/20 to 30/70 | 10 | 0.5 | 40 |
| 105 | 94 | 5014.1 | 5013.7 | 6.33 | D | 80/20 to 30/70 | 10 | 0.5 | 40 |
| 106 | 95 | 5024.3 | 5023.7 | 6.31 | D | 80/20 to 30/70 | 10 | 0.5 | 40 |
| 107 | 96 | 4986.3 | 4985.6 | 5.90 | D | 80/20 to 30/70 | 10 | 0.5 | 40 |
| 108 | 97 | 4996.3 | 4995.6 | 6.00 | D | 80/20 to 30/70 | 10 | 0.5 | 40 |
| 109 | 98 | 4996.4 | 4995.6 | 5.97 | D | 80/20 to 30/70 | 10 | 0.5 | 40 |
| 110 | 99 | 5026.2 | 5025.7 | 5.98 | D | 80/20 to 30/70 | 10 | 0.5 | 40 |
| 111 | 100 | 5012.1 | 5011.6 | 5.95 | D | 80/20 to 30/70 | 10 | 0.5 | 40 |
| 112 | 101 | 4986.0 | 4985.6 | 5.95 | D | 80/20 to 30/70 | 10 | 0.5 | 40 |
| 113 | 102 | 4986.1 | 4985.6 | 5.95 | D | 80/20 to 30/70 | 10 | 0.5 | 40 |

TABLE 2-continued

Characterization of the exemplified GIP receptor agonist peptides of the present disclosure.

| SEQ ID NO. | Compound No. | Mass obs. | Mass calc. | HPLC retention time (min) | HPLC conditions (Column)[a] | HPLC gradient A/B (A: 0.1% TFA-water: B: 0.1% TFA-acetonitrile) | HPLC gradient time (min) | HPLC Flow rate (mL/min) | HPLC Temp: °C. |
|---|---|---|---|---|---|---|---|---|---|
| 114 | 103 | 4986.0 | 4985.6 | 5.94 | D | 80/20 to 30/70 | 10 | 0.5 | 40 |
| 115 | 104 | 4996.0 | 4995.6 | 5.93 | D | 80/20 to 30/70 | 10 | 0.5 | 40 |

[a]HPLC Conditions Column A: YMC-Triart C8-s5 (4.6 × 100 mmI.D.); Column B: Kinetex XB-C18 100 A (4.6 × 100 mmI.D.); Column C: Chromolith Performance RP-18e 100-4.6 mm; Column D: Kinetex 1.7 μm C8 100 A, (100 × 2.1 mmID)

Example 3. Additional Peptide Synthesis Methods

The peptide was synthesized using standard Fmoc chemistry.
(1) To the 1-chloro-2-[chloro(diphenyl)methyl]benzene (0.1 mmol, 1.0 eq) was added FMOC-SER(TBU)-OH (115 mg, 300 μmol, 3.0 eq) and DIEA (77.5 mg, 600 μmol, 104 μL, 6.0 eq) in DCM (5 mL). The mixture was agitated with $N_2$ for 2 h at 20° C., then added MeOH (0.2 mL) and agitated with $N_2$ for another 30 min. Drain and then DMF wash 30 sec with 3 times.
(2) Add 20% piperidine/DMF and mix for 30 min.
(3) Drain and then DMF wash 30 sec with 5 times.
(4) Add Fmoc-amino acid solution and mix 30 seconds, then add activation buffer, $N_2$ bubbling for about 1 hour. Add 20% piperidine/DMF and react on 30 min.
(5) Repeat step 2 to 5 for next amino acid coupling.

TABLE 3

Materials and methods for synthesizing an exemplary GIP receptor agonist peptide of the present disclosure

| # | Materials | Coupling reagents |
|---|---|---|
| 1 | Fmoc-Ser(tBu)-OH (1.0 eq) | DIEA(4.0 eq) |
| 2 | Fmoc-Pro-OH (3.0 eq) | HBTU(2.85 eq) and DIEA(6.0 eq) |
| 3 | Fmoc-Pro-OH (3.0 eq) | HBTU(2.85 eq) and DIEA(6.0 eq) |
| 4 | Fmoc-Pro-OH (3.0 eq) | HBTU(2.85 eq) and DIEA(6.0 eq) |
| 5 | Fmoc-Ala-OH (3.0 eq) | HBTU(2.85 eq) and DIEA(6.0 eq) |
| 6 | Fmoc-Gly-OH (3.0 eq) | HBTU(2.85 eq) and DIEA(6.0 eq) |
| 7 | Fmoc-Ser(tBu)-OH (3.0 eq) | HBTU(2.85 eq) and DIEA(6.0 eq) |
| 8 | Fmoc-Ser(tBu)-OH (3.0 eq) | HBTU(2.85 eq) and DIEA(6.0 eq) |
| 9 | Fmoc-Pro-OH (3.0 eq) | HBTU(2.85 eq) and DIEA(6.0 eq) |
| 10 | Fmoc-Lys(Dde)-OH (3.0 eq) | HBTU(2.85 eq) and DIEA(6.0 eq) |
| 11 | Fmoc-Gln(Trt)-OH (3.0 eq) | HBTU(2.85 eq) and DIEA(6.0 eq) |
| 12 | Fmoc-Ala-OH (3.0 eq) | HBTU(2.85 eq) and DIEA(6.0 eq) |
| 13 | Fmoc-Iva-OH (3.0 eq) | HBTU(2.85 eq) and DIEA(6.0 eq) |
| 14 | Fmoc-Trp(Boc)-OH (3.0 eq) | HATU(2.85 eq) and DIEA(6.0 eq) |
| 15 | Fmoc-Asn(Trt)-OH (3.0 eq) | HATU(2.85 eq) and DIEA(6.0 eq) |
| 16 | Fmoc-Val-OH (3.0 eq) | HATU(2.85 eq) and DIEA(6.0 eq) |
| 17 | Fmoc-Phe-OH (3.0 eq) | HATU(2.85 eq) and DIEA(6.0 eq) |
| 18 | Fmoc-Asn(Trt)-OH (3.0 eq) | HATU(2.85 eq) and DIEA(6.0 eq) |
| 19 | Fmoc-Aib-OH (3.0 eq) | HATU(2.85 eq) and DIEA(6.0 eq) |
| 20 | Fmoc-Asn(Trt)-OH (3.0 eq) | HATU(2.85 eq) and DIEA(6.0 eq) |
| 21 | Fmoc-Gln(Trt)-OH (3.0 eq) | HATU(2.85 eq) and DIEA(6.0 eq) |
| 22 | Fmoc-His(Trt)-OH (3.0 eq) | HATU(2.85 eq) and DIEA(6.0 eq) |
| 23 | Fmoc-Aib-OH (3.0 eq) | HATU(2.85 eq) and DIEA(6.0 eq) |
| 24 | Fmoc-Arg(Pbf)-OH (3.0 eq) | HATU(2.85 eq) and DIEA(6.0 eq) |
| 25 | Fmoc-Asp(OtBu)-OH (3.0 eq)` | HATU(2.85 eq) and DIEA(6.0 eq) |
| 26 | Fmoc-Leu-OH (3.0 eq) | HATU(2.85 eq) and DIEA(6.0 eq) |
| 27 | Fmoc-Ala-OH (3.0 eq) | HATU(2.85 eq) and DIEA(6.0 eq) |
| 28 | Fmoc-Ile-OH (3.0 eq) | HATU(2.85 eq) and DIEA(6.0 eq) |
| 29 | Fmoc-Ser(tBu)-OH (3.0 eq) | HATU(2.85 eq) and DIEA(6.0 eq) |
| 30 | Fmoc-Tyr(tBu)-OH (3.0 eq) | HATU(2.85 eq) and DIEA(6.0 eq) |
| 31 | Fmoc-Asp(OtBu)-OH (3.0 eq)` | HATU(2.85 eq) and DIEA(6.0 eq) |
| 32 | Fmoc-Ser(tBu)-OH (3.0 eq) | HATU(2.85 eq) and DIEA(6.0 eq) |
| 33 | Fmoc-Ile-OH (3.0 eq) | HATU(2.85 eq) and DIEA(6.0 eq) |
| 34 | Fmoc-Phe-OH (3.0 eq) | HATU(2.85 eq) and DIEA(6.0 eq) |

TABLE 3-continued

Materials and methods for synthesizing an exemplary GIP receptor agonist peptide of the present disclosure

| # | Materials | Coupling reagents |
|---|---|---|
| 35 | Fmoc-Thr(tBu)-OH (3.0 eq) | HATU(2.85 eq) and DIEA(6.0 eq) |
| 36 | Fmoc-Gly-OH (3.0 eq) | HATU(2.85 eq) and DIEA(6.0 eq) |
| 37 | Fmoc-Glu(OtBu)-OH (3.0 eq) | HATU(2.85 eq) and DIEA(6.0 eq) |
| 38 | Fmoc-Aib-OH (3.0 eq) | HATU(2.85 eq) and DIEA(6.0 eq) |
| 39 | Fmoc-NMe-Tyr(tBu)-OH (3.0 eq) | HATU(2.85 eq) and DIEA(6.0 eq) |
| 40 | Boc2O (3.0 eq) | DIEA (6.0 eq) |
| 41 | Fmoc-Gly-Gly-Gly-OH (3.0 eq) | HATU(2.85 eq) and DIEA(6.0 eq) |
| 42 | Fmoc-Gly-Gly-OH (3.0 eq) | HATU(2.85 eq) and DIEA(6.0 eq) |
| 43 | Fmoc-γGlu(OtBu)-OH (3.0 eq) | HATU(2.85 eq) and DIEA(6.0 eq) |
| 44 | C18DA(3.0eq) | HATU(2.85 eq) and DIEA(6.0 eq) |

20% piperidine in DMF was used for Fmoc deprotection for 30 min. 3% $NH_2NH_2$ in DMF was used for Dde deprotection for 20 min for twice. The coupling reaction was monitored by ninhydrin test, and the resin was washed with DMF for 5 times.

Peptide Cleavage and Purification:
(1) Add cleavage buffer (90% TFA/2.5% EDT/2.5% TIS/2.5% H2O/2.5% methylsulfanylbenzene) to the flask containing the side chain protected peptide at room temperature and stir for 3 hours.
(2) Filter and collect the filtrate. The peptide is precipitated with cold tert-butyl methyl ether and centrifuged (3 min at 3000 rpm).
(3) Tert-butyl methyl ether washes two additional times.
(4) Dry the crude peptide under vacuum 2 hours.
(5) Purify the crude peptide by Prep-HPLC (A: 0.075% TFA in H2O, B: ACN) and then by prep-HPLC (HOAc condition; A: 0.5% HOAc in H2O, B: ACN) to give the final product (17 mg, 3.37 μmol, 3.3% yield, 99.2% purity, HOAC).

TABLE 4

Purification conditions used to synthesize an exemplary GIP receptor agonist peptide of the present disclosure
Purification conditions:

| First Purification condition | |
|---|---|
| Dissolution condition | Dissolve in 10% ACN-H2O |
| Instrument | Gilson GX-281 |
| Mobile Phase | A: H2O (0.075% TFA in H2O) |
| | B: CH3CN |
| Gradient | 25-45%-60 min. Retention time: 37 min |
| Column | luna, c18, 10 um, 100A + Gemini, 5 um, c18, 110A |
| Flow Rate | 20 mL/Min |
| Wavelength | 214/254 nm |
| Oven Tem. | Room temperature |

TABLE 4-continued

Purification conditions used to synthesize an exemplary GIP receptor agonist peptide of the present disclosure
Purification conditions:

Second Purification condition

| | |
|---|---|
| Dissolution condition | Dissolve in 20% ACN-H₂O |
| Instrument | Gilson GX-281 |
| Mobile Phase | A: H₂O (0.5% HOAc in H₂O) |
| | B: CH₃CN |
| Gradient | 0.2M AcONH4 25 min; 0.5% AcOH in H₂O 10 min; 25-45%-60 min. Retention time: 38 min |
| Column | luna, c18, 10 um, 100A + Gemini, 5 um, c18, 110A |
| Flow Rate | 20 mL/Min |
| Wavelength | 214/254 nm |
| Oven Tem. | Room temperature |

TABLE 6

Exemplary GIP receptor agonist peptides made according to Example 3.

| SEQ ID NO: | Compound No. | MS Calc. (M/3) + 1 | MW_[OBS_(M/3) + 1] | HPLC_RT_[min] |
|---|---|---|---|---|
| 116 | 441 | 1672.5 | 1672.23 | 7.892 |
| 117 | 442 | 1681.9 | 1681.91 | 9.601 |
| 118 | 443 | 1691.2 | 1691.25 | 10.88 |
| 119 | 444 | 1672.5 | 1672.23 | 11.304 |
| 120 | 445 | 1681.9 | 1681.91 | 9.172 |
| 121 | 446 | 1691.2 | 1691.26 | 10.456 |
| 122 | 447 | 1682.5 | 1682.52 | 7.896 |
| 123 | 448 | 1691.9 | 1691.91 | 9.173 |
| 124 | 449 | 1701.2 | 1701.26 | 10.878 |
| 125 | 450 | 1677.9 | 1677.85 | 7.895 |
| 126 | 451 | 1687.2 | 1687.24 | 9.171 |
| 127 | 452 | 1696.6 | 1696.59 | 10.878 |
| 128 | 453 | 1669.2 | 1669.18 | 7.892 |
| 129 | 454 | 1678.5 | 1678.57 | 9.175 |
| 130 | 455 | 1687.9 | 1687.91 | 10.88 |
| 131 | 456 | 1669.2 | 1668.89 | 7.893 |
| 132 | 457 | 1678.5 | 1678.57 | 9.173 |
| 133 | 458 | 1687.9 | 1687.92 | 10.879 |
| 134 | 459 | 1669.2 | 1669.23 | 7.896 |
| 135 | 460 | 1678.5 | 1678.57 | 9.175 |
| 136 | 461 | 1687.9 | 1687.92 | 10.882 |
| 137 | 462 | 1672.5 | 1672.23 | 7.896 |
| 138 | 463 | 1681.9 | 1681.91 | 9.175 |
| 139 | 464 | 1691.2 | 1691.25 | 10.882 |
| 140 | 465 | 1649.5 | 1649.54 | 8.748 |
| 141 | 466 | 1658.8 | 1658.88 | 10.024 |
| 142 | 467 | 1668.2 | 1667.9 | 11.305 |
| 143 | 468 | 1669.2 | 1669.23 | 11.306 |
| 144 | 469 | 1678.5 | 1678.57 | 8.744 |
| 145 | 470 | 1687.9 | 1687.58 | 10.453 |
| 146 | 476 | 1670.9 | 1670.86 | 8.322 |
| 147 | 477 | 1680.2 | 1680.21 | 9.598 |
| 148 | 478 | 1689.6 | 1689.54 | 10.882 |
| 149 | 479 | 1674.2 | 1674.24 | 8.32 |
| 150 | 480 | 1683.6 | 1683.54 | 9.597 |
| 151 | 481 | 1692.9 | 1692.89 | 11.305 |
| 152 | 482 | 1651.2 | 1651.17 | 9.17 |
| 153 | 483 | 1660.5 | 1660.52 | 10.452 |
| 154 | 484 | 1669.9 | 1669.87 | 12.157 |
| 155 | 485 | 1670.9 | 1670.86 | 7.89 |
| 156 | 486 | 1680.2 | 1680.2 | 9.172 |
| 157 | 487 | 1689.6 | 1689.55 | 10.883 |
| 158 | 488 | 1674.2 | 1674.2 | 9.319 |
| 159 | 489 | 1683.6 | 1683.54 | 9.602 |
| 160 | 490 | 1692.9 | 1692.89 | 11.306 |
| 161 | 491 | 1674.2 | 1674.2 | 9.322 |
| 162 | 492 | 1683.6 | 1683.54 | 9.6 |
| 163 | 493 | 1692.9 | 1692.89 | 11.307 |
| 164 | 494 | 1684.2 | 1684.2 | 9.319 |
| 165 | 495 | 1693.6 | 1693.55 | 9.603 |
| 166 | 496 | 1702.9 | 1702.89 | 10.879 |
| 167 | 497 | 1679.5 | 1679.53 | 8.319 |
| 168 | 498 | 1688.9 | 1688.88 | 8.599 |
| 169 | 499 | 1698.2 | 1698.22 | 10.879 |
| 170 | 500 | 1670.9 | 1670.86 | 8.317 |
| 171 | 501 | 1680.2 | 1680.21 | 9.601 |
| 172 | 502 | 1689.6 | 1689.55 | 11.309 |
| 173 | 503 | 1670.9 | 1670.86 | 9.601 |
| 174 | 504 | 1680.2 | 1680.21 | 9.598 |
| 175 | 505 | 1689.6 | 1689.55 | 11.308 |
| 176 | 506 | 1602.8 | 1602.48 | 9.171 |
| 177 | 507 | 1612.1 | 1611.83 | 10.453 |
| 178 | 508 | 1621.5 | 1621.17 | 8.75 |
| 179 | 509 | 1622.5 | 1622.17 | 7.893 |
| 180 | 510 | 1631.8 | 1631.51 | 9.173 |
| 181 | 511 | 1641.2 | 1640.86 | 10.45 |
| 182 | 512 | 1625.8 | 1625.84 | 8.318 |
| 183 | 513 | 1635.2 | 1634.85 | 9.598 |
| 184 | 514 | 1644.5 | 1644.53 | 10.878 |
| 185 | 515 | 1625.8 | 1625.5 | 8.322 |
| 186 | 516 | 1635.2 | 1634.85 | 9.601 |
| 187 | 517 | 1644.5 | 1644.53 | 10.877 |
| 188 | 518 | 1635.8 | 1635.84 | 8.321 |
| 189 | 519 | 1645.2 | 1645.19 | 9.601 |
| 190 | 520 | 1654.5 | 1654.54 | 10.88 |
| 191 | 521 | 1631.2 | 1630.84 | 8.319 |
| 192 | 522 | 1640.5 | 1640.52 | 9.602 |
| 193 | 523 | 1649.9 | 1649.87 | 10.877 |
| 194 | 524 | 1622.5 | 1622.17 | 8.319 |
| 195 | 525 | 1631.8 | 1631.51 | 9.602 |
| 196 | 526 | 1641.2 | 1640.86 | 10.878 |
| 197 | 527 | 1622.5 | 1622.17 | 8.321 |
| 198 | 528 | 1631.8 | 1631.52 | 9.598 |
| 199 | 529 | 1641.2 | 1640.86 | 10.883 |
| 200 | 530 | 1622.5 | 1622.18 | 8.317 |
| 201 | 531 | 1631.8 | 1631.51 | 9.601 |
| 202 | 532 | 1641.2 | 1640.85 | 10.879 |
| 203 | 533 | 1625.8 | 1625.85 | 8.323 |
| 204 | 534 | 1635.2 | 1635.19 | 9.603 |
| 205 | 535 | 1644.5 | 1644.53 | 11.307 |
| 206 | 536 | 1592.1 | 1591.82 | 10.451 |
| 207 | 537 | 1611.8 | 1611.5 | 9.17 |
| 208 | 538 | 1615.2 | 1614.84 | 9.597 |
| 209 | 539 | 1615.2 | 1614.85 | 9.6 |
| 210 | 540 | 1625.2 | 1624.85 | 9.601 |
| 211 | 541 | 1620.5 | 1620.17 | 9.176 |
| 212 | 542 | 1611.8 | 1611.51 | 9.172 |
| 213 | 543 | 1611.8 | 1611.5 | 9.6 |
| 214 | 544 | 1611.8 | 1611.51 | 9.603 |
| 215 | 545 | 1615.2 | 1614.84 | 9.603 |
| 216 | 546 | 1606.8 | 1606.49 | 10.027 |
| 217 | 547 | 1626.5 | 1626.17 | 9.125 |
| 218 | 548 | 1629.8 | 1629.51 | 9.174 |
| 219 | 549 | 1629.8 | 1629.84 | 9.171 |
| 220 | 550 | 1639.8 | 1639.85 | 9.176 |
| 221 | 551 | 1635.2 | 1635.17 | 9.172 |
| 222 | 552 | 1626.5 | 1626.18 | 9.172 |
| 223 | 553 | 1626.5 | 1626.17 | 9.171 |
| 224 | 554 | 1626.5 | 1626.51 | 9.176 |
| 225 | 555 | 1629.8 | 1629.52 | 9.597 |

TABLE 7

| SEQ ID NO: | Compound No | MS Calc. (M/4) + 1 | MS [Obs] | HPLC RT (min) |
|---|---|---|---|---|
| 226 | 908 | 1257.90 | 1258.92[M + 4H]$^{4+}$ | 25-55__20 min (10.45) |
| 227 | 909 | 1264.91 | 1265.93[M + 4H]$^{4+}$ | 30-60__20 min (8.31) |
| 228 | 910 | 1271.93 | 1272.93[M + 4H]$^{4+}$ | 30-60__20 min (9.60) |
| 229 | 911 | 1259.16 | 1260.18[M + 4H]$^{4+}$ | 25-55__20 min (10.88) |
| 230 | 912 | 1266.18 | 1267.18[M + 4H]$^{4+}$ | 30-60__20 min (8.74) |
| 231 | 913 | 1273.19 | 1274.19[M + 4H]$^{4+}$ | 30-60__20 min (10.03) |
| 232 | 892 | 1261.67 | 1262.39[M + 4H]$^{4+}$ | 30-60__20 min (7.89) |
| 233 | 893 | 1268.69 | 1269.69[M + 4H]$^{4+}$ | 30-60__20 min (9.17) |
| 234 | 894 | 1275.70 | 1276.69[M + 4H]$^{4+}$ | 30-60__20 min (10.60) |
| 235 | 914 | 1260.41 | 1261.42[M + 4H]$^{4+}$ | 25-55__20 min (10.88) |
| 236 | 915 | 1267.42 | 1268.43[M + 4H]$^{4+}$ | 30-60__20 min (8.74) |
| 237 | 916 | 1274.44 | 1275.40[M + 4H]$^{4+}$ | 30-60__20 min (9.95) |
| 238 | 895 | 1260.41 | 1261.39[M + 4H]$^{4+}$ | 30-60__20 min (7.44) |
| 239 | 896 | 1267.42 | 1268.43[M + 4H]$^{4+}$ | 30-60__20 min (8.74) |
| 240 | 897 | 1274.44 | 1275.43[M + 4H]$^{4+}$ | 30-60__20 min (9.82) |
| 241 | 898 | 1261.67 | 1262.64[M + 4H]$^{4+}$ | 30-60__20 min (7.95) |
| 242 | 899 | 1268.69 | 1269.69[M + 4H]$^{4+}$ | 30-60__20 min (9.17) |
| 243 | 900 | 1275.70 | 1276.40[M + 4H]$^{4+}$ | 30-60__20 min (10.54) |
| 244 | 901 | 1267.92 | 1268.93[M + 4H]$^{4+}$ | 25-55__20 min (10.87) |
| 245 | 947 | 1274.93 | 1275.93[M + 4H]$^{4+}$ | 30-60__20 min (8.74) |
| 246 | 948 | 1281.94 | 1282.94[M + 4H]$^{4+}$ | 25-55__20 min (13.01) |
| 247 | 949 | 1269.18 | 1270.19[M + 4H]$^{4+}$ | 30-60__20 min (7.89) |
| 248 | 950 | 1276.19 | 1277.19[M + 4H]$^{4+}$ | 30-60__20 min (9.17) |
| 249 | 951 | 1283.21 | 1284.19[M + 4H]$^{4+}$ | 30-60__20 min (10.45) |
| 250 | 917 | 1279.70 | 1280.65[M + 4H]$^{4+}$ | 30-60__20 min (10.37) |
| 251 | 952 | 1264.41 | 1265.43[M + 4H]$^{4+}$ | 25-55__20 min (10.87) |
| 252 | 953 | 1271.42 | 1272.43[M + 4H]$^{4+}$ | 30-60__20 min (8.32) |
| 253 | 954 | 1278.44 | 1279.40[M + 4H]$^{4+}$ | 30-60__20 min (9.84) |
| 254 | 955 | 1265.67 | 1266.67[M + 4H]$^{4+}$ | 30-60__20 min (7.49) |
| 255 | 956 | 1272.69 | 1273.65[M + 4H]$^{4+}$ | 30-60__20 min (9.14) |
| 256 | 918 | 1257.90 | 1258.91[M + 4H]$^{4+}$ | 25-55__20 min (10.87) |
| 257 | 919 | 1264.91 | 1265.93[M + 4H]$^{4+}$ | 25-55__20 min (11.73) |
| 258 | 920 | 1271.93 | 1272.90[M + 4H]$^{4+}$ | 30-60__20 min (9.86) |
| 259 | 921 | 1259.16 | 1260.14[M + 4H]$^{4+}$ | 30-60__20 min (7.83) |
| 260 | 922 | 1266.18 | 1267.15[M + 4H]$^{4+}$ | 30-60__20 min (9.05) |
| 261 | 923 | 1273.19 | 1274.19[M + 4H]$^{4+}$ | 30-60__20 min (10.45) |
| 262 | 924 | 1257.90 | 1258.92[M + 4H]$^{4+}$ | 25-55__20 min (10.87) |
| 263 | 925 | 1264.91 | 1265.92[M + 4H]$^{4+}$ | 25-55__20 min (11.73) |
| 264 | 926 | 1271.93 | 1272.65[M + 4H]$^{4+}$ | 30-60__20 min (9.90) |
| 265 | 927 | 1259.16 | 1260.18[M + 4H]$^{4+}$ | 30-60__20 min (7.49) |
| 266 | 928 | 1266.18 | 1267.15[M + 4H]$^{4+}$ | 30-60__20 min (9.05) |
| 267 | 929 | 1273.19 | 1274.19[M + 4H]$^{4+}$ | 30-60__20 min (10.45) |
| 268 | 930 | 1257.90 | 1258.63[M + 4H]$^{4+}$ | 30-60__20 min (7.32) |
| 269 | 931 | 1264.91 | 1265.93[M + 4H]$^{4+}$ | 25-55__20 min (11.73) |
| 270 | 932 | 1271.93 | 1272.90[M + 4H]$^{4+}$ | 30-60__20 min (10.57) |
| 271 | 933 | 1259.16 | 1260.18[M + 4H]$^{4+}$ | 30-60__20 min (7.89) |
| 272 | 934 | 1266.18 | 1267.14[M + 4H]$^{4+}$ | 30-60__20 min (9.05) |
| 273 | 935 | 1273.19 | 1274.15[M + 4H]$^{4+}$ | 30-60__20 min (10.47) |
| 274 | 936 | 1260.41 | 1261.42[M + 4H]$^{4+}$ | 25-55__20 min (10.45) |
| 275 | 937 | 1267.42 | 1268.43[M + 4H]$^{4+}$ | 25-55__20 min (11.73) |
| 276 | 938 | 1274.44 | 1275.44[M + 4H]$^{4+}$ | 30-60__20 min (9.59) |
| 277 | 939 | 1261.67 | 1262.69[M + 4H]$^{4+}$ | 30-60__20 min (7.89) |
| 278 | 940 | 1268.69 | 1269.67[M + 4H]$^{4+}$ | 30-60__20 min (9.17) |
| 279 | 941 | 1275.70 | 1276.66[M + 4H]$^{4+}$ | 30-60__20 min (10.35) |
| 280 | 942 | 1168.05 | 1168.87[M + 4H]$^{4+}$ | 30-60__20 min (9.59) |
| 281 | 943 | 1246.87 | 1247.65[M + 4H]$^{4+}$ | 30-60__20 min (9.17) |

BIOLOGICAL EXAMPLES

Methods for performing GIP and GLP receptor binding assays, assays for inhibition of emesis, vomiting and nausea, caused by various stimuli, including from drug or chemotherapy induced nemesis are specifically described in Applicant's International PCT Application No. PCT/JP2018/013540, filed on Mar. 30, 2018, ranging from pages 213 to 255, and are specifically incorporated herein by reference in their entirety.

Example 1. Evaluation of Agonist Activity on Human GIPR and Human GLP-1R with Increase in Intracellular cAMP Concentration as Indicator A) Evaluation of Agonist Activity on Human GIPR and Human GLP-IR with Increase in Intracellular cAMP Concentration as Indicator
(1) Construction of Expression Plasmid of Human GIPR Gene. The Human GIPR Gene Having an Identical Sequence to Genebank Accession No. U39231 was Cloned into a pMSRα-Neo Vector to Prepare hGIPR/pMSRα-Neo.
(2) Construction of Reporter Plasmid Expressing Cell Luciferase Reporter Gene with a cAMP-Responsive Sequence Located Upstream was Transferred to a CHO-K1 Cell to Construct a CRE-LUC/CHO-K1 Cell.
(3) Construction of Reporter Plasmid
Four Copies of a cAMP responsive sequence and a Zeocin resistance gene were transferred to pGL3(R2.2)-Basic Vector (Promega) to construct a Cre-luc(Zeo) reporter plasmid.
(4) Transfer of Human GIPR Gene to CRE-LUC/CHO-K1 Cell and Obtaining of Expressing Cell the Plasmid hGIPR/pMSRα-Neo Obtained in (1) was Transferred to the CRE-LUC.

CHO-K1 cell obtained in (2) to obtain a transformant. Subsequently, the cell line inducing the luciferase expression, hGIPR/CRE-LUC/CHO-K1 cell, was selected from the obtained transformant by adding GIP.
(5) Construction of Expression Plasmid of Human GLP-1R Gene
The human GLP-IR gene having an identical sequence to Genebank Accession No. NM_002062 was cloned into a pIRESneo3 vector to prepare hGLP-1/pIRESneo3.
(6) Transfer of Human GLP-1R Gene and Reporter Plasmid to CHO-K1 Cell and Obtaining of Expressing Cell
The Cre-luc (Zeo) obtained in (3) and the plasmid hGLP-1/pIRESneo3 obtained in (5) were transferred to the CHO-K1 cell to obtain a transformant. Subsequently, the cell line inducing the luciferase expression, hGLP-1R/CRE-luc/CHO-K1 cell, was selected from the obtained transformant by adding GLP-1.
(7) Reporter Assay 25 µL each of the hGIPR/CRE-LUC/CHO-K1 cell was inoculated in a 384-well white plate (Corning) in such a way as to provide 5×103 cells/well and cultured in a HamF12 medium containing 10% fetal bovine serum, 100 U/mL penicillin, and 100 µg/mL streptomycin in a CO2 incubator at 37° C. overnight. 5 µL of a medium containing a test compound was added to the cells and incubated for 4 hours at the indicated concentration in a CO2 incubator at 37° C. Steady-Glo (Promega) was added in amounts of 30 µL and shaken under light shielding. 20 Minutes later, luciferase activity was measured using a plate reader Envision (PerkinElmer). The GIPR agonist activity was calculated with increase in intracellular cAMP concentration as the indicator when the luciferase activity in the presence of 10 nM of GIP was 100% and the luciferase activity in the case of adding DMSO instead of the test compound was 0%.

The GLP-IR agonist activity was assayed in the same manner as above using the hGLP-1R/CRE-luc/CHO-K1 cell. The GLP-1R agonist activity was calculated with increase in intracellular CAMP concentration as the indicator when the luciferase activity in the presence of 10 nM of GLP-1 was 100% and the luciferase activity in the case of adding DMSO instead of the test compound was 0%.

As shown in Table 6, the GIP receptor agonist peptides of the present disclosure have an excellent GIP receptor selective activation action.

TABLE 8

GIP Receptor Selective Activation Of Various GIP receptor agonist peptides of the disclosure

| SEQ ID NO. | Compound No. | hGIPR (polyclonal) Reporter ($EC_{50}$)(nM) | hGLP-1R (Reporter gene assay)($EC_{50}$)(nM) |
|---|---|---|---|
| 12 | 1 | 0.76 | >1000 |
| 13 | 2 | 0.19 | >1000 |
| 14 | 3 | 0.03 | 160 |
| 15 | 4 | 0.11 | >1000 |
| 16 | 5 | 0.14 | >1000 |
| 17 | 6 | 0.5 | >1000 |
| 18 | 7 | 0.15 | >1000 |
| 19 | 8 | 0.04 | 180 |
| 20 | 9 | 0.06 | 190 |
| 21 | 10 | 0.03 | 210 |
| 22 | 11 | 0.1 | 180 |
| 23 | 12 | 0.005 | 86 |
| 24 | 13 | 0.54 | >1000 |
| 25 | 14 | 0.005 | 140 |
| 26 | 15 | 0.005 | 40 |
| 27 | 16 | 0.01 | >1000 |
| 28 | 17 | 0.34 | >1000 |
| 29 | 18 | 0.01 | 210 |
| 30 | 19 | 1.2 | >1000 |
| 31 | 20 | 0.1 | >1000 |
| 32 | 21 | 0.01 | >1000 |
| 33 | 22 | 0.05 | >1000 |
| 34 | 23 | 0.1 | >1000 |
| 35 | 24 | 0.013 | >1000 |
| 36 | 25 | 0.05 | >1000 |
| 37 | 26 | 0.1 | >1000 |
| 38 | 27 | 0.005 | >1000 |
| 39 | 28 | 0.01 | >1000 |
| 40 | 29 | 0.02 | >1000 |
| 41 | 30 | 0.0054 | >1000 |
| 42 | 31 | 0.02 | >1000 |
| 43 | 32 | 0.02 | >1000 |
| 44 | 33 | 0.02 | >1000 |
| 45 | 34 | 0.11 | >1000 |
| 46 | 35 | 0.01 | >1000 |
| 47 | 36 | 0.05 | >1000 |
| 48 | 37 | 0.02 | >1000 |
| 49 | 38 | 0.05 | >1000 |
| 50 | 39 | 0.01 | >1000 |
| 51 | 40 | 0.03 | >1000 |
| 52 | 41 | 0.01 | >1000 |
| 53 | 42 | 0.03 | >1000 |
| 54 | 43 | 0.01 | >1000 |
| 55 | 44 | 0.01 | >1000 |
| 56 | 45 | 0.005 | >1000 |
| 57 | 46 | 0.01 | >1000 |
| 58 | 47 | 0.03 | >1000 |
| 59 | 48 | 0.07 | >1000 |
| 60 | 49 | 0.02 | >1000 |
| 61 | 50 | 0.08 | >1000 |
| 62 | 51 | 0.01 | >1000 |
| 63 | 52 | 0.03 | >1000 |
| 64 | 53 | 0.02 | >1000 |
| 65 | 54 | 0.04 | >1000 |
| 66 | 55 | 0.01 | >1000 |
| 67 | 56 | 0.02 | >1000 |

TABLE 8-continued

GIP Receptor Selective Activation Of Various GIP receptor agonist peptides of the disclosure

| SEQ ID NO. | Compound No. | hGIPR (polyclonal) Reporter ($EC_{50}$)(nM) | hGLP-1R (Reporter gene assay)($EC_{50}$)(nM) |
|---|---|---|---|
| 68 | 57 | 0.01 | >1000 |
| 69 | 58 | 0.01 | >1000 |
| 70 | 59 | 0.01 | >1000 |
| 71 | 60 | 0.06 | >1000 |
| 72 | 61 | 0.1 | >1000 |
| 73 | 62 | 0.01 | >1000 |
| 74 | 63 | 0.02 | >1000 |
| 75 | 64 | 0.01 | >1000 |
| 76 | 65 | 0.04 | >1000 |
| 77 | 66 | 0.09 | >1000 |
| 78 | 67 | 0.005 | >1000 |
| 79 | 68 | 0.02 | >1000 |
| 80 | 69 | 0.04 | >1000 |
| 81 | 70 | 0.01 | >1000 |
| 82 | 71 | 0.07 | >1000 |
| 83 | 72 | 0.15 | >1000 |
| 84 | 73 | 0.01 | >1000 |
| 85 | 74 | 0.02 | >1000 |
| 86 | 75 | 0.03 | >1000 |
| 87 | 76 | 0.05 | >1000 |
| 88 | 77 | 0.08 | >1000 |
| 89 | 78 | 0.041 | >1000 |
| 90 | 79 | 0.034 | >1000 |
| 91 | 80 | 0.027 | >1000 |
| 92 | 81 | 0.023 | >1000 |
| 93 | 82 | 0.037 | >1000 |
| 94 | 83 | 0.03 | >1000 |
| 95 | 84 | 0.038 | >1000 |
| 96 | 85 | 0.033 | >1000 |
| 97 | 86 | 0.044 | >1000 |
| 98 | 87 | 0.02 | >1000 |
| 99 | 88 | 0.02 | >1000 |
| 100 | 89 | 0.02 | >1000 |
| 101 | 90 | 0.02 | >1000 |
| 102 | 91 | 0.02 | >1000 |
| 103 | 92 | 0.03 | >1000 |
| 104 | 93 | 0.02 | >1000 |
| 105 | 94 | 0.03 | >1000 |
| 106 | 95 | 0.02 | >1000 |
| 107 | 96 | 0.0063 | >1000 |
| 108 | 97 | 0.005 | >1000 |
| 109 | 98 | 0.005 | >1000 |
| 110 | 99 | 0.005 | >1000 |
| 111 | 100 | 0.0062 | >1000 |
| 112 | 101 | 0.0057 | >1000 |
| 113 | 102 | 0.0057 | >1000 |
| 114 | 103 | 0.005 | >1000 |
| 115 | 104 | 0.0067 | >1000 |

Example 4—Evaluation of Peptide Agonist Activity on Human GIPR and Human GLP1R by Measuring Intracellular cAMP Accumulation (HDB Protocol)

GIPR Assay

HEK-293T cells overexpressing full-length human GIPR with a sequence identical to GenBank accession number NM_000164 with an N-terminal FLAG tag are purchased from Multispan, Inc (Hayward, CA). Cells are cultured per the manufacturer's protocol in DMEM with 10% fetal bovine serum and 1 μg/mL puromycin, and stored in frozen aliquots to be used as assay ready cells. On the day of the assay, cells are removed from frozen storage, washed two times in 1× Kreb's Ringer Buffer (Zenbio, Research Triangle Park, NC), and re-suspended to a concentration of $4\times10^5$ cells/mL in 1× Kreb's Ringer Buffer. 50 nL of test compound in 100% DMSO spanning a final concentration range of $3\times10^{-10}$-$5.08\times10^{-15}$ M are acoustically dispensed in low volume, white, 384-well polypropylene plates (Corning, Tewksbury, MA), followed by the addition of $4\times10^3$ cells per well in total volume of 10 μL. Cells are incubated with test compound for 1 hr at room temperature in the dark, and cAMP accumulation is measured using the Cisbio HiRange cAMP assay kit (Bedford, MA) per the manufacturer's protocol. Anti-cAMP antibody and d2-cAMP tracer reagents diluted in lysis/detection buffer are incubated in the dark for 1 hr, and results are measured on an Envision plate reader (Perkin Elmer, Waltham, MA). Data is normalized using 1 nM GIP as 100% activity, and DMSO alone as 0% activity.

Example 5—GLP1R Assay

HEK-293T cells overexpressing full-length human GLP-1R with a sequence identical to GenBank accession number NM_002062 with an N-terminal FLAG tag may be purchased from Multispan, Inc (Hayward, CA). Cells are cultured per the manufacturer's protocol in DMEM with 10% fetal bovine serum and 1 μg/mL puromycin, and stored in frozen aliquots to be used as assay ready cells. On the day of the assay, cells are removed from frozen storage, washed two times in 1× Kreb's Ringer Buffer (Zenbio, Research Triangle Park, NC), and re-suspended to a concentration of $4\times10^5$ cells/mL in 1× Kreb's Ringer Buffer. 50 nL of test compound in 100% DMSO spanning a final concentration range of $1\times10^{-6}$-$1.69\times10^{-11}$ M are acoustically dispensed in low volume, white, 384-well polypropylene plates (Corning, Tewksbury, MA), followed by the addition of $4\times10^3$ cells per well in total volume of 10 μL. Cells are incubated with test compound for 1 hr at room temperature in the dark, and cAMP accumulation is measured using the Cisbio HiRange cAMP assay kit (Bedford, MA) per the manufacturer's protocol. Anti-cAMP antibody and d2-cAMP tracer reagents diluted in lysis/detection buffer are incubated in the dark for 1 hr, and results are measured on an Envision plate reader (Perkin Elmer, Waltham, MA). Data is normalized using 1 nM GLP-1 as 100% activity, and DMSO alone as 0% activity.

TABLE 9

GIP Receptor Selective Activation Of Various GIP receptor agonist peptides of the disclosure

| SEQ ID NO: | Compound No. | GIP_$EC_{50}$(pM) | GLP_$EC_{50}$ (nM) |
|---|---|---|---|
| 116 | 441 | 0.33 | >1000 |
| 117 | 442 | 1.01 | >1000 |
| 118 | 443 | 0.86 | 977.2 |
| 119 | 444 | 0.39 | >1000 |
| 120 | 445 | 0.38 | >1000 |
| 121 | 446 | 0.85 | 891.3 |
| 122 | 447 | 0.31 | >1000 |
| 123 | 448 | 0.54 | >1000 |
| 124 | 449 | 0.65 | 912.0 |
| 125 | 450 | 0.40 | >1000 |
| 126 | 451 | 0.74 | >1000 |
| 127 | 452 | 2.17 | >1000 |
| 128 | 453 | 0.60 | >1000 |
| 129 | 454 | 1.14 | >1000 |
| 130 | 455 | 2.24 | >1000 |
| 131 | 456 | 0.57 | >1000 |
| 132 | 457 | 0.82 | >1000 |
| 133 | 458 | 1.31 | >1000 |
| 134 | 459 | 0.41 | >1000 |
| 135 | 460 | 0.44 | >1000 |
| 136 | 461 | 1.30 | >1000 |
| 137 | 462 | 0.35 | >1000 |
| 138 | 463 | 0.52 | >1000 |

TABLE 9-continued

GIP Receptor Selective Activation Of Various GIP receptor agonist peptides of the disclosure

| SEQ ID NO: | Compound No. | GIP_EC$_{50}$(pM) | GLP_EC$_{50}$ (nM) |
|---|---|---|---|
| 139 | 464 | 1.29 | 977.2 |
| 140 | 465 | 0.26 | >1000 |
| 141 | 466 | 0.39 | >1000 |
| 142 | 467 | 0.79 | >1000 |
| 143 | 468 | 0.44 | >1000 |
| 144 | 469 | 0.62 | >1000 |
| 145 | 470 | 1.12 | >1000 |
| 146 | 476 | 0.74 | >1000 |
| 147 | 477 | 0.64 | >1000 |
| 148 | 478 | 1.36 | >1000 |
| 149 | 479 | 0.42 | >1000 |
| 150 | 480 | 0.50 | >1000 |
| 151 | 481 | 0.61 | >1000 |
| 152 | 482 | 0.31 | >1000 |
| 153 | 483 | 0.50 | >1000 |
| 154 | 484 | 1.08 | >1000 |
| 155 | 485 | 0.28 | >1000 |
| 156 | 486 | 0.70 | >1000 |
| 157 | 487 | 1.38 | >1000 |
| 158 | 488 | 0.75 | >1000 |
| 159 | 489 | 0.96 | >1000 |
| 160 | 490 | 1.88 | >1000 |
| 161 | 491 | 0.70 | >1000 |
| 162 | 492 | 1.22 | >1000 |
| 163 | 493 | 1.22 | >1000 |
| 164 | 494 | 0.50 | >1000 |
| 165 | 495 | 0.86 | >1000 |
| 166 | 496 | 1.09 | >1000 |
| 167 | 497 | 0.40 | >1000 |
| 168 | 498 | 0.60 | >1000 |
| 169 | 499 | 1.17 | >1000 |
| 170 | 500 | 0.59 | >1000 |
| 171 | 501 | 0.92 | >1000 |
| 172 | 502 | 1.78 | >1000 |
| 173 | 503 | 0.49 | >1000 |
| 174 | 504 | 1.08 | >1000 |
| 175 | 505 | 2.11 | >1000 |
| 176 | 506 | 1.93 | >1000 |
| 177 | 507 | 1.38 | >1000 |
| 178 | 508 | 2.21 | >1000 |
| 179 | 509 | 0.54 | >1000 |
| 180 | 510 | 0.83 | >1000 |
| 181 | 511 | 1.61 | >1000 |
| 182 | 512 | 0.53 | 125.9 |
| 183 | 513 | 0.50 | >1000 |
| 184 | 514 | 1.14 | >1000 |
| 185 | 515 | 0.54 | >1000 |
| 186 | 516 | 1.02 | >1000 |
| 187 | 517 | 1.99 | >1000 |
| 188 | 518 | 0.61 | >1000 |
| 189 | 519 | 1.26 | >1000 |
| 190 | 520 | 2.68 | >1000 |
| 191 | 521 | 0.90 | >1000 |
| 192 | 522 | 1.51 | >1000 |
| 193 | 523 | 2.98 | >1000 |
| 194 | 524 | 1.29 | >1000 |
| 195 | 525 | 0.82 | >1000 |
| 196 | 526 | 1.50 | >1000 |
| 197 | 527 | 0.37 | 478.6 |
| 198 | 528 | 0.87 | >1000 |
| 199 | 529 | 1.30 | >1000 |
| 200 | 530 | 0.36 | >1000 |
| 201 | 531 | 1.02 | >1000 |
| 202 | 532 | 2.05 | >1000 |
| 203 | 533 | 0.59 | 776.2 |
| 204 | 534 | 0.81 | >1000 |
| 205 | 535 | 1.54 | >1000 |
| 206 | 536 | 0.95 | >1000 |
| 207 | 537 | 1.32 | >1000 |
| 208 | 538 | 1.80 | >1000 |
| 209 | 539 | 2.66 | >1000 |
| 210 | 540 | 3.01 | >1000 |
| 211 | 541 | 0.73 | >1000 |
| 212 | 542 | 1.21 | >1000 |
| 213 | 543 | 0.72 | >1000 |
| 214 | 544 | 0.94 | >1000 |
| 215 | 545 | 0.43 | >1000 |
| 216 | 546 | 0.46 | >1000 |
| 217 | 547 | 0.41 | >1000 |
| 218 | 548 | 0.81 | >1000 |
| 219 | 549 | 0.85 | >1000 |
| 220 | 550 | 0.83 | >1000 |
| 221 | 551 | 0.60 | >1000 |
| 222 | 552 | 1.12 | >1000 |
| 223 | 553 | 1.08 | >1000 |
| 224 | 554 | 0.82 | >1000 |
| 225 | 555 | 0.97 | >1000 |

TABLE 10

| SEQ ID NO: | Compound No | GIP_EC$_{50}$(pM) | GLP_EC$_{50}$ (nM) |
|---|---|---|---|
| 226 | 908 | 0.7 | 17.8 |
| 227 | 909 | 0.7 | 10.5 |
| 228 | 910 | 0.7 | 1000.0 |
| 229 | 911 | 0.8 | 93.3 |
| 230 | 912 | 0.7 | 104.7 |
| 231 | 913 |  | 575.4 |
| 232 | 892 | 1.7 | 151.4 |
| 233 | 893 | 2.3 | 2.1 |
| 234 | 894 | 1.9 | 794.3 |
| 235 | 914 | 0.5 | 28.8 |
| 236 | 915 | 0.8 | 871.0 |
| 237 | 916 | 1.2 | 346.7 |
| 238 | 895 | 1.2 | 234.4 |
| 239 | 896 | 1.3 | 1000.0 |
| 240 | 897 | 0.9 | 91.2 |
| 241 | 898 | 0.6 | 74.1 |
| 242 | 899 | 0.7 | 144.5 |
| 243 | 900 | 0.7 | 218.8 |
| 244 | 901 | 0.5 | 195.0 |
| 245 | 947 | 0.9 | 645.7 |
| 246 | 948 | 0.6 | 1000.0 |
| 247 | 949 | 0.5 | 631.0 |
| 248 | 950 | 0.6 | 524.8 |
| 249 | 951 | 1.0 | 120.2 |
| 250 | 917 | 0.5 | 1000.0 |
| 251 | 952 | 1.3 | 38.9 |
| 252 | 953 | 1.0 | 30.9 |
| 253 | 954 | 1.4 | 138.0 |
| 254 | 955 | 0.6 | 1000.0 |
| 255 | 956 | 0.6 | 5.5 |
| 256 | 918 | 0.5 | 89.1 |
| 257 | 919 | 0.6 | 1000.0 |
| 258 | 920 | 1.1 | 190.5 |
| 259 | 921 | 0.5 | 125.9 |
| 260 | 922 | 0.6 | 17.8 |
| 261 | 923 | 0.8 | 120.2 |
| 262 | 924 | 0.6 | 562.3 |
| 263 | 925 | 0.7 | 70.8 |
| 264 | 926 | 1.1 | 199.5 |
| 265 | 927 | 1.3 | 436.5 |
| 266 | 928 | 1.6 | 134.9 |
| 267 | 929 | 1.8 | 46.8 |
| 268 | 930 | 0.7 | 138.0 |
| 269 | 931 | 1.1 | 30.9 |
| 270 | 932 | 1.1 | 125.9 |
| 271 | 933 | 0.6 | 97.7 |
| 272 | 934 | 0.6 | 436.5 |
| 273 | 935 | 1.0 | 1000.0 |
| 274 | 936 | 0.6 | 794.3 |

TABLE 10-continued

| SEQ ID NO: | Compound No | GIP_EC$_{50}$(pM) | GLP_EC$_{50}$ (nM) |
|---|---|---|---|
| 275 | 937 | 0.7 | 31.6 |
| 276 | 938 | 0.9 | 93.3 |
| 277 | 939 | 0.6 | 1000.0 |
| 278 | 940 | 0.7 | 524.8 |
| 279 | 941 | 0.4 | 1000.0 |
| 280 | 942 | 1.4 | 4.3 |
| 281 | 943 | 1.5 | 1.2 |

Example 6. Evaluation of Binding Activity to Human GIPR Using [$^{125}$I]-GIP (1) Construction of Expression Plasmid of Human GIPR Gene The human GIPR gene having an identical sequence to Genebank Accession No. U39231 is cloned into a pcDNA3.3 vector to prepare hGIPR/pcDNA3.3.

Example 7—Preparation of Human GIPR_Virus-Like Particle (VLP) Using Expi293F Cell On the day before transfection, 850 mL of Expi293F cells are inoculated in a concentration of 1.8×10$^6$ cells/mL in a 3-L flask (Corning Incorporated) and cultured under conditions of 37° C., 8% CO$_2$, 85 rpm for 24 hours. The transfection is s carried out using Expi293 Expression System Kit (Thermo Fisher Scientific). More specifically, 0.67 mg of pcDNA3.3/hGIPR and 0.33 mg of pcDNA3.3/GAG plasmid for VLP preparation are added to 50 mL of opti-MEM (Thermo Fisher Scientific) to prepare a DNA mixture. Subsequently, 2.7 mL of Expifectamine is added to 50 mL of opti-MEM and allowed to stand for 5 minutes, then the DNA mixture is mixed thereinto and the resulting mixture is allowed to stand for 20 minutes and then further added to the culture medium. Twenty (20) hours after transfection, 5 mL of Enhancers 1 and 50 mL of Enhancers 2 are added thereto. Ninety-six (96) hours after transfection, the culture medium is centrifuged at 850×g for 15 minutes to thereby obtain a supernatant. The obtained supernatant is ultra-centrifuged at 54000×g for 1 hour to thereby obtain a GIPR-VLP fraction. The precipitate is washed once with PBS and then suspended in a small amount of PBS to thereby obtain GIPR-VLP. The obtained GIPR-VLP is stored at −80° C. until used. Protein quantification is carried out using GelCode Blue Safe Protein Stain (Thermo Fisher Scientific) with BSA as the standard.

Example 8—Measurement of Binding Activity of Test Compounds to Human GIPR

For the measurement of the binding activity to GIPR, [$^{125}$I]GIP (PerkinElmer, Inc.) in a final concentration of 100 pM and a test compound in a specified concentration are mixed to GIPR-VLP in an assay buffer (50 mM HEPES (pH 7.4, WAKO 342-01375), 5 mM EGTA (WAKO 346-01312), 5 mM MgCl$_2$ (WAKO 136-03995), 0.1% BSA (Merckmillipore 81-066-04) and 0.005% Tween 20 (BioRad 170-6531)) and reacted at room temperature for 2 hours. VLP to which [$^{125}$I]GIP is bound is trapped in a GF/C glass fiber filter 96-well plate (PerkinElmer 6005274) using a cell harvester and washed with an assay buffer. The GF/C glass fiber 96-well plate in which VLP is trapped is dried at 42° C. overnight. Thereafter, MicroScint-O (PerkinElmer 6013611) is added to the GF/C glass fiber filter 96-well plate sealed using a backseal and the plate is sealed using a topseal. The radioactivity of each well is eventually measured using Topcount (PerkinElmer) and the binding activity of the test compound to GIPR is calculated when the [$^{125}$I]GIP binding activity in the presence of GIP in a final concentration of 1 μm is 100% and the [$^{125}$I]GIP binding activity of the wells to which DMSO is added is 0%.

Example 9—Evaluation of Peptide Agonist Activity on Human GIPR and Human GLPIR by Measuring Intracellular cAMP Accumulation GIPR Assay HEK-293T cells overexpressing full-length human GIPR with a sequence identical to GenBank accession number NM_000164 with an N-terminal FLAG tag are purchased from Multispan, Inc (Hayward, CA). Cells are cultured per the manufacturer's protocol in DMEM with 10% fetal bovine serum and 1 μg/mL puromycin, and stored in frozen aliquots to be used as assay ready cells. On the day of the assay, cells are removed from frozen storage, washed two times in 1× Kreb's Ringer Buffer (Zenbio, Research Triangle Park, NC), and re-suspended to a concentration of 4×10$^5$ cells/mL in 1× Kreb's Ringer Buffer. 50 nL of test compound in 100% DMSO spanning a final concentration range of 3×10$^{-10}$-5.08×10$^{-15}$ M are acoustically dispensed in low volume, white, 384-well polypropylene plates (Corning, Tewksbury, MA), followed by the addition of 4×10$^3$ cells per well in total volume of 10 μL. Cells are incubated with test compound for 1 hr at room temperature in the dark, and cAMP accumulation is measured using the Cisbio HiRange CAMP assay kit (Bedford, MA) per the manufacturer's protocol. Anti-cAMP antibody and d2-cAMP tracer reagents diluted in lysis/detection buffer are incubated in the dark for 1 hr, and results are measured on an Envision plate reader (Perkin Elmer, Waltham, MA). Data is normalized using 1 nM GIP as 100% activity, and DMSO alone as 0% activity.

Example 10. In-Vivo Effect of GIP Receptor Agonist Peptides on Emesis in Morphine Induced Emesis Model In Live Male Ferrets Effect of Subcutaneously Administered GIP Receptor Agonist Peptide in Morphine-Induced Acute Emetic Model.

To evaluate the antiemetic effect, the GIP receptor agonist peptides other than natural human GIP are subcutaneously administered into male ferrets 30 minutes before morphine administration. GIP receptor agonist peptide compounds of the present disclosure are dosed of 30 nmol/kg completely attenuate the morphine (0.6 mg/kg, s.c.)-induced emesis in the ferrets. Up to 60 minutes after morphine administration, the condition of the ferrets is monitored to record the frequencies and time points of abdominal contraction motions, vomiting behaviors, licking with the tongue, and fidgety behavior occurring.

Effects of Subcutaneously Administered Selective GIP Agonist Peptides in Morphine-Induced Acute Emetic Model 30 nmol/kg of GIP receptor agonist peptides are dessolved with a vehicle (0.09 w/v % tween 80/10% DMSO/saline), respectively, to prepare test solutions. 0.5 mg/kg of the test solutions and the vehicle are subcutaneously administered to ferrets (4 in each group), respectively. At the time of each of 4 hours, after administration, 0.6 mg/kg of morphine is subcutaneously administered. Up to 60 minutes after morphine administration, the condition of the ferrets is moni- Formulation Example 1

| (1) | Compound 10 | 10.0 mg |
|---|---|---|
| (2) | Lactose | 70.0 mg |
| (3) | Cornstarch | 50.0 mg |
| (4) | Soluble starch | 7.0 mg |
| (5) | Magnesium stearate | 3.0 mg |

Compound 10 (10.0 mg) and magnesium stearate (3.0 mg) are granulated with an aqueous soluble starch solution (0.07 mL) (7.0 mg as soluble starch), dried and mixed with lactose (70.0 mg) and cornstarch (50.0 mg). The mixture is compressed to give a tablet.

Formulation Example 2

| (1) | Compound 5 | 5.0 mg |
|---|---|---|
| (2) | Sodium chloride | 20.0 mg |
| (3) | Distilled water | 2 mL |
| | to total amount | |

Compound 5 (5.0 mg) and sodium chloride (20.0 mg) are dissolved in distilled water, and water is added to a total amount of 2.0 ml. The solution is filtered, and filled in a 2 ml ampoule under aseptic conditions. The ampoule is sterilized and tightly sealed to give a solution for injection.

INDUSTRIAL APPLICABILITY

The GIP receptor agonist peptides of the present disclosure have superior GIP receptor selective agonist activity, and are useful as a drug for the prophylaxis or treatment of emesis and conditions caused by associated with GIP receptor activity, for example, emesis and diseases associated with vomiting or nausea and the like. In one embodiment, the selective GIP receptor agonist peptides are useful as a drug or medicament, or for use in the prophylaxis or treatment of emesis and conditions caused by associated with GIP receptor activity, for example cyclic vomiting syndrome, and nausea and/or vomiting associated with administration of a chemotherapeutic or anti-cancer agent as illustrated herein.

All the publications, patents, and the patent applications cited herein are incorporated herein by reference in their entireties.

[Free Text for Sequence Listing]
  SEQ ID NO: 1: Natural human GIP (1-42 peptide)
  SEQ ID NO: 2: Natural human GIP (1-153: Signal peptide: 1-21: Propeptide: 22-50: Peptide: 52-93: Propeptide: 95-153.)
  SEQ ID NO: 3: mRNA sequence of natural human GIP of SEQ ID NO: 2.
  SEQ ID NOs: 4 to 11: Reference GIP receptor agonist peptides (Formulas I to VIII)
  SEQ ID NO: 12 to 281 Synthetic peptides (Formulas (I)-(VIII)

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the claims.

SEQUENCE LISTING (893 sequences)

SEQ ID NO: 1 - protein, 42 aa, Homo sapiens
YAEGTFISDYSIAMDKIHQQDFVNWLLAQKGKKNDWKHNITQ

SEQ ID NO: 2 - protein, 153 aa, Homo sapiens
MVATKTFALLLLSLFLAVGLGEKKEGHFSALPSLPVGSHAKVSSPQPRGPRYAEGTFISDYSIAMDKIHQQDFVNWLLAQKGKKNDWKHNITQREARALELASQANRKEEEAVEPQSSPAKNPSDEDLLRDLLIQELLACLLDQTNLCRLRSR

SEQ ID NO: 3 - RNA, 711 nt, Homo sapiens
aggcucagaagguccagaaaucaggggaaggagaccccuaucuguccuucuucuggaagagcuggaaaggaagucugcucaggaaauaaccuuggaagaugguggccacgaagaccuuugcucugcugcugcugucccuguuccuggcagugggacuaggagagaagaaagagggucacuucagcgcucuccccucccugccuguuggaucucaugcuaaggugagcagcccucaaccucgaggccccagguacgcggaagggacuuucaucagugacuacaguauugccauggacaagauucaccaacaagacuuugugaacuggcugcuggcccaaaaggggaagaagaaugacuggaaacacaacaucacccagagggaggcucgggcgcuggagcuggccagucaagcuaauaggaaggaggaggaggcaguggagccacagagcuccccagccaagaaccccagcgaugaagauuugcugcgggacuugcugauucaagagcuguuggccugcuugcuggaucagacaaaccucugcaggcucaggucucggugacucugaccacacccagcucaggacuggauucugcccuucacuuagcaccugccucagccccacuccagaauagccaagagaacccaaaccaauaaaguuuaugcuaagucgagcccauugugaaaauuuauuaaaaugacuacugagcacu

SEQ ID NO: 4 - protein, 41 aa, Artificial Sequence
  Synthetic peptide
  MISC_FEATURE (1)..(1): Xaa represents Tyr, 3,5-Dix Tyr, D-Tyr, 3,5 di-Br-Tyr, Phe, Methyl-Phe, mono-halo-Phe, bis-halo-Phe, -Tyr, -D-Phe, -D-Tyr, des-amino-Phe, or des-amino-Tyr
  MISC_FEATURE (2)..(2): Xaa represents Aib, Ala, Gly, Sar, Abu, or D-Ala
  MISC_FEATURE (3)..(3): Xaa represents Glu or Pro
  MISC_FEATURE (4)..(4): Xaa represents Gly, or Ser
  MISC_FEATURE (5)..(5): Xaa represents Thr, D-Iva, Glu, Iva, or Ser
  MISC_FEATURE (6)..(6): Xaa represents Ala, Aib, alpha-Methyl-Phe, A6C, Glu, Iva, Arg, Phe, or Val
  MISC_FEATURE (7)..(7): Xaa represents Ile, Lys, Val, Ala, Aib, alpha-methyl-Leu, A6C, Asp, Phe, Gly, Iva, Leu, Arg, or Ser
  MISC_FEATURE (8)..(8): Xaa represents Ser, Ala, Aib, Asp, Phe, Gly, Leu, or Arg
  MISC_FEATURE (9)..(9): Xaa represents Asp, Leu, Aib, Glu, Asn, Gln, Ser, or Phe
  MISC_FEATURE (10)..(10): Xaa represents Aib, alpha-Methyl-Phe, A6C, Lys, or Tyr
  MISC_FEATURE (11)..(11): Xaa represents Aib Ser, Ala, Glu, Iva, A5c, A6c, or Leu
  MISC_FEATURE (12)..(12): Xaa represents Ile, Ala, Aib, Glu, alpha-Methyl-Phe, Phe, Lys, Arg, Ser, Trp, A6C, Cys, or Asp
  MISC_FEATURE (13)..(13): Xaa represents Aib, Ala, Val, Iva, Gln, Leu, Tyr, D-Iva, alpha-Methyl-Phe, A6C, or Glu
  MISC_FEATURE (14)..(14): Xaa represents Leu, Nle, Tyr, Ala, Aib, alpha-Methyl-Leu, Lys, Leu, Ser, Met, or Me
  MISC_FEATURE (15)..(15): Xaa represents Ala, Aib, Leu, Asn, Asp, Glu, Lys, Ser, or Tyr
  MISC_FEATURE (16)..(16): Xaa represents Arg Ala, Aib, Glu, Gly, Leu, Ser, or Lys
  MISC_FEATURE (17)..(17): Xaa represents Aib, Ala, Lys, Asp, Arg, Gln, Glu, or Ile
  MISC_FEATURE (18)..(18): Xaa represents Ala, Aib, A6C, Phe, Gly, Iva, Leu, Ser, Trp, or His
  MISC_FEATURE (19)..(19): Xaa represents Gln, Ala, Val, Aib, Ile, Arg, or Ser
  MISC_FEATURE (20)..(20): Xaa represents Aib, Ala, Arg, Glu, Gly, Ser, Val, or Gln
  MISC_FEATURE (21)..(21): Xaa represents Asn, Asp, Glu, Leu, Ala, Aib, Lys, Gln, or Ser
  MISC_FEATURE (22)..(22): Xaa represents Phe, Glu, Gln, Arg, Trp, or alphaMePhe
  MISC_FEATURE (23)..(23): Xaa represents Ile, Aib, Asp, Glu, Arg, Thr or Val
  MISC_FEATURE (24)..(24): Xaa represents Arg, Asn, Asp, Lys, Lys(Ac), Ala, Aib, Cys, Phe, Leu, Nle, Ser, Asp, or Gln
  MISC_FEATURE (25)..(25): Xaa represents Trp, Aib, alpha-Methyl-Leu, A6C, Ile, Asn, Nle, Arg, or Val
  MISC_FEATURE (26)..(26): Xaa represents Aib, Iva, Ala, alpha-Methyl-Leu, A6C, Ile, Asn, Nle, Arg, Val, or Leu
  MISC_FEATURE (27)..(27): Xaa represents Leu, Val, Ala, Aib, alpha-Methyl-Leu, A6C, Ile, Met, Nle, Arg, Trp, or Ile
  MISC_FEATURE (28)..(28): Xaa represents Ala, Arg, Lys, Aib, Asp, Asn, or Lys(Ac)
  MISC_FEATURE (29)..(29): Xaa represents Gln, Gly, Arg, Glu, Leu, or Aib
  MISC_FEATURE (30)..(30): Xaa represents  Lys, Arg, Gly, or Glu
  MISC_FEATURE (31)..(31): Xaa represents Pro, Gly, Hyp, Gln, Phe, psi, or a deletion
  MISC_FEATURE (32)..(32): Xaa represents Ser, Gly, Arg, Lys, psi, or a deletion
  MISC_FEATURE (33)..(33): Xaa represents Ser, Gly, Pro, Lys, psi, or a deletion
  MISC_FEATURE (34)..(34): Xaa represents Gly, Ser, Asn, psi or a deletion
  MISC_FEATURE (35)..(35): Xaa represents Ala, Ser, Ser, Asp, psi, or a deletion
  MISC_FEATURE (36)..(36): Xaa represents Pro, Gly, Gly, Hyp, Trp, psi, or a deletion
  MISC_FEATURE (37)..(37): Xaa represents Pro, Gly, Ala, Hyp, Lys, psi, or a deletion
  MISC_FEATURE (38)..(38): Xaa represents Pro, Gly, Hyp, His, psi, or a deletion
  MISC_FEATURE (39)..(39): Xaa represents Ser, Gly, Lys, Pro, Asn, psi, or a deletion
  MISC_FEATURE (40)..(40): Xaa represents Arg, Ser, Cys, Glu, Lys, Lys-Ac, Pro, Ile, psi, or a deletion
  MISC_FEATURE (41)..(41): Xaa represents Gly, Ser, Ile, Thr, psi, or a deletion
XXXXXXXXXXXXXXXXXXXXXXXXXXXXXXXXXXXXXXXXX

SEQ ID NO: 5 - protein, 41 aa, Artificial Sequence
  Synthetic peptide
  MISC_FEATURE (2)..(2): Xaa represents Aib or D-Ala
  MISC_FEATURE (6)..(6): Xaa represents Iva, Phe, or Val
  MISC_FEATURE (7)..(7): Xaa represents Ile, Lys, or Val
  MISC_FEATURE (8)..(8): Xaa represents Ser
  MISC_FEATURE (9)..(9): Xaa represents Asp, Leu, or Phe
  MISC_FEATURE (10)..(10): Xaa represents Tyr
  MISC_FEATURE (11)..(11): Xaa represents Aib or Ser
  MISC_FEATURE (12)..(12): Xaa represents Ile
  MISC_FEATURE (13)..(13): Xaa represents Aib, Ala, Gln, Leu, Tyr, or D-Iva
  MISC_FEATURE (14)..(14): Xaa represents Leu
  MISC_FEATURE (15)..(15): Xaa represents Asp, Glu, Lys, Ser, or Tyr
  MISC_FEATURE (16)..(16): Xaa represents Arg or Lys
  MISC_FEATURE (17)..(17): Xaa represents Aib, Gln, or Ile
  MISC_FEATURE (18)..(18): Xaa represents Ala or His
  MISC_FEATURE (19)..(19): Xaa represents Gln or Ser
  MISC_FEATURE (20)..(20): Xaa represents Aib, Ala, or Gln
  MISC_FEATURE (21)..(21): Xaa represents Asn, Asp, Glu, Leu, or Ser
  MISC_FEATURE (22)..(22): Xaa represents Phe or alpha-MePhe
  MISC_FEATURE (23)..(23): Xaa represents Ile or Val
  MISC_FEATURE (24)..(24): Xaa represents Arg, Asn, Asp, Lys, or Lys(Ac)
  MISC_FEATURE (25)..(25): Xaa represents Trp
  MISC_FEATURE (26)..(26): Xaa represents Aib, Iva, or Leu
  MISC_FEATURE (27)..(27): Xaa represents Leu
  MISC_FEATURE (28)..(28): Xaa represents Ala, Arg, Lys, or Lys(Ac)
  MISC_FEATURE (29)..(29): Xaa represents Gln or Gly
  MISC_FEATURE (30)..(30): Xaa represents Arg, or Gly
  MISC_FEATURE (31)..(31): Xaa represents Pro, Gly, psi, or a deletion
  MISC_FEATURE (32)..(32): Xaa represents Ser, Gly, psi, or a deletion
  MISC_FEATURE (33)..(33): Xaa represents Ser, Gly, psi, or a deletion
  MISC_FEATURE (34)..(34): Xaa represents Gly, psi, or a deletion
  MISC_FEATURE (35)..(35): Xaa represents Ala, Ser, psi, or a deletion
  MISC_FEATURE (36)..(36): Xaa represents Pro, Gly, psi, or a deletion
  MISC_FEATURE (37)..(37): Xaa represents Pro, Gly, psi, or a deletion
  MISC_FEATURE (38)..(38): Xaa represents  Pro, Gly, psi, or a deletion
  MISC_FEATURE (39)..(39): Xaa represents Ser, Gly, psi, or a deletion
  MISC_FEATURE (40)..(40): Xaa represents Arg, Ser, psi, or a deletion
  MISC_FEATURE (41)..(41): Xaa represents Gly, psi, or a deletion
YXEGTXXXXXXXXXXXXXXXXXXXXXXXXXXXXXXXXXXXX

SEQ ID NO: 6 - protein, 41 aa, Artificial Sequence; identical to SEQ ID NO: 5
  Synthetic peptide
  MISC_FEATURE (2)..(2): Xaa represents Aib or D-Ala
  MISC_FEATURE (6)..(6): Xaa represents Iva, Phe, or Val
  MISC_FEATURE (7)..(7): Xaa represents Ile, Lys, or Val
  MISC_FEATURE (8)..(8): Xaa represents Ser
  MISC_FEATURE (9)..(9): Xaa represents Asp, Leu, or Phe
  MISC_FEATURE (10)..(10): Xaa represents Tyr
  MISC_FEATURE (11)..(11): Xaa represents Aib or Ser
  MISC_FEATURE (12)..(12): Xaa represents Ile
  MISC_FEATURE (13)..(13): Xaa represents Aib, Ala, Gln, Leu, Tyr, or D-Iva
  MISC_FEATURE (14)..(14): Xaa represents Leu
  MISC_FEATURE (15)..(15): Xaa represents Asp, Glu, Lys, Ser, or Tyr
  MISC_FEATURE (16)..(16): Xaa represents Arg or Lys
  MISC_FEATURE (17)..(17): Xaa represents Aib, Gln, or Ile
  MISC_FEATURE (18)..(18): Xaa represents Ala or His
  MISC_FEATURE (19)..(19): Xaa represents Gln or Ser
  MISC_FEATURE (20)..(20): Xaa represents Aib, Ala, or Gln
  MISC_FEATURE (21)..(21): Xaa represents Asn, Asp, Glu, Leu, or Ser
  MISC_FEATURE (22)..(22): Xaa represents Phe or alpha-MePhe
  MISC_FEATURE (23)..(23): Xaa represents Ile or Val
  MISC_FEATURE (24)..(24): Xaa represents Arg, Asn, Asp, Lys, or Lys(Ac)
  MISC_FEATURE (25)..(25): Xaa represents Trp
  MISC_FEATURE (26)..(26): Xaa represents Aib, Iva, or Leu
  MISC_FEATURE (27)..(27): Xaa represents Leu
  MISC_FEATURE (28)..(28): Xaa represents Ala, Arg, Lys, or Lys(Ac)
  MISC_FEATURE (29)..(29): Xaa represents Gln or Gly
  MISC_FEATURE (30)..(30): Xaa represents Arg, or Gly
  MISC_FEATURE (31)..(31): Xaa represents Pro, Gly, psi, or a deletion
  MISC_FEATURE (32)..(32): Xaa represents Ser, Gly, psi, or a deletion
  MISC_FEATURE (33)..(33): Xaa represents Ser, Gly, psi, or a deletion
  MISC_FEATURE (34)..(34): Xaa represents Gly, psi, or a deletion
  MISC_FEATURE (35)..(35): Xaa represents Ala, Ser, psi, or a deletion
  MISC_FEATURE (36)..(36): Xaa represents Pro, Gly, psi, or a deletion
  MISC_FEATURE (37)..(37): Xaa represents Pro, Gly, psi, or a deletion
  MISC_FEATURE (38)..(38): Xaa represents Pro, Gly, psi, or a deletion
  MISC_FEATURE (39)..(39): Xaa represents Ser, Gly, psi, or a deletion
  MISC_FEATURE (40)..(40): Xaa represents Arg, Ser, psi, or a deletion
  MISC_FEATURE (41)..(41): Xaa represents Gly, psi, or a deletion

SEQ ID NO: 7 - protein, 41 aa, Artificial Sequence
  Synthetic peptide
  MISC_FEATURE (1)..(1): Xaa represents Tyr
  MISC_FEATURE (2)..(2): Xaa represents represents Aib or D-Ala
  MISC_FEATURE (6)..(6): Xaa represents Iva, Phe, or Val
  MISC_FEATURE (7)..(7): Xaa represents Ile, Lys, or Val
  MISC_FEATURE (8)..(8): Xaa represents Ser
  MISC_FEATURE (9)..(9): Xaa represents Asp, Leu, or Phe
  MISC_FEATURE (10)..(10): Xaa represents Tyr
  MISC_FEATURE (11)..(11): Xaa represents Aib or Ser
  MISC_FEATURE (12)..(12): Xaa represents Ile
  MISC_FEATURE (13)..(13): Xaa represents Aib, Ala, Gln, Leu, Tyr, or D-Iva
  MISC_FEATURE (14)..(14): Xaa represents Leu
  MISC_FEATURE (15)..(15): Xaa represents Asp, Glu, Lys, Ser, or Tyr
  MISC_FEATURE (16)..(16): Xaa represents Arg or Lys
  MISC_FEATURE (17)..(17): Xaa represents Aib, Gln, or Ile
  MISC_FEATURE (18)..(18): Xaa represents Ala or His
  MISC_FEATURE (19)..(19): Xaa represents Gln or Ser
  MISC_FEATURE (20)..(20): Xaa represents Aib, Ala, or Gln
  MISC_FEATURE (21)..(21): Xaa represents Asn, Asp, Glu, Leu, or Ser
  MISC_FEATURE (22)..(22): Xaa represents Phe or alpha-MePhe
  MISC_FEATURE (23)..(23): Xaa represents Ile or Val
  MISC_FEATURE (24)..(24): Xaa represents Arg, Asn, Asp, Lys, or Lys(Ac)
  MISC_FEATURE (25)..(25): Xaa represents Trp
  MISC_FEATURE (26)..(26): Xaa represents Aib, Iva, or Leu
  MISC_FEATURE (27)..(27): Xaa represents Leu
  MISC_FEATURE (28)..(28): Xaa represents Ala, Arg, Lys, or Lys(Ac)
  MISC_FEATURE (29)..(29): Xaa represents Gln or Gly
  MISC_FEATURE (30)..(30): Xaa represents Arg
  MISC_FEATURE (31)..(31): Xaa represents Pro, Gly, psi, or a deletion
  MISC_FEATURE (32)..(32): Xaa represents Ser, Gly, psi, or a deletion
  MISC_FEATURE (33)..(33): Xaa represents Ser, Gly, psi, or a deletion
  MISC_FEATURE (34)..(34): Xaa represents Gly, psi, or a deletion
  MISC_FEATURE (35)..(35): Xaa represents Ala, Ser, psi, or a deletion
  MISC_FEATURE (36)..(36): Xaa represents Pro, Gly, psi, or a deletion
  MISC_FEATURE (37)..(37): Xaa represents Pro, Gly, psi, or a deletion
  MISC_FEATURE (38)..(38): Xaa represents Pro, Gly, psi, or a deletion
  MISC_FEATURE (39)..(39): Xaa represents Ser, Gly, psi, or a deletion
  MISC_FEATURE (40)..(40): Xaa represents Arg, Ser, psi, or a deletion
  MISC_FEATURE (41)..(41): Xaa represents Gly, psi, or a deletion
XXEGTXXXXXXXXXXXXXXXXXXXXXXXXXXXXXXXXXXXX

SEQ ID NO: 8 - protein, 29 aa, Artificial Sequence
  Synthetic peptide
  MISC_FEATURE (2)..(2): Xaa represents Aib
  MISC_FEATURE (17)..(17): Xaa represents Aib
  MISC_FEATURE (20)..(20): Xaa represents Aib
  MISC_FEATURE (26)..(26): Xaa represents Iva
YXEGTFISDYSIALDRXHQXNFVNWXLAQ

SEQ ID NO: 9 - protein, 41 aa, Artificial Sequence
  Synthetic peptide
  MISC_FEATURE (2)..(2): Xaa represents Aib
  MISC_FEATURE (17)..(17): Xaa represents Aib
  MISC_FEATURE (20)..(20): Xaa represents Aib
  MISC_FEATURE (26)..(26): Xaa represents Iva
  MISC_FEATURE (30)..(30): Xaa represents Arg
  MISC_FEATURE (31)..(31): Xaa represents Pro, Gly, or Lys(R)
  MISC_FEATURE (32)..(32): Xaa represents Ser, Gly, or Lys(R)
  MISC_FEATURE (33)..(33): Xaa represents Ser, Gly, or Lys(R)
  MISC_FEATURE (34)..(34): Xaa represents Gly, or Lys(R)
  MISC_FEATURE (35)..(35): Xaa represents Ala, Ser, or Lys(R)
  MISC_FEATURE (36)..(36): Xaa represents Pro, Gly, or Lys(R)
  MISC_FEATURE (37)..(37): Xaa represents Pro, Gly, Lys(R), or a deletion
  MISC_FEATURE (38)..(38): Xaa represents Pro, Gly, Lys(R), or a deletion
  MISC_FEATURE (39)..(39): Xaa represents Ser, Gly, Lys(R), or a deletion
  MISC_FEATURE (40)..(40): Xaa represents Arg, Ser, Lys(R), or a deletion
  MISC_FEATURE (41)..(41): Xaa represents Gly, Lys(R), or a deletion
YXEGTFISDYSIALDRXHQXNFVNWXLAQXXXXXXXXXXXX

SEQ ID NO: 10 - protein, 39 aa, Artificial Sequence
  Synthetic peptide
  MISC_FEATURE (2)..(2): Xaa represents Aib
  MISC_FEATURE (17)..(17): Xaa represents Aib
  MISC_FEATURE (20)..(20): Xaa represents Aib
  MISC_FEATURE (26)..(26): Xaa represents Iva
  MISC_FEATURE (30)..(30): Xaa represents Arg
  MISC_FEATURE (31)..(31): Xaa represents Pro, Gly, or Lys(R)
  MISC_FEATURE (32)..(32): Xaa represents Ser, Gly, or Lys(R)
  MISC_FEATURE (33)..(33): Xaa represents Ser, Gly, or Lys(R)
  MISC_FEATURE (34)..(34): Xaa represents Gly, or Lys(R)
  MISC_FEATURE (35)..(35): Xaa represents Ala, Ser, or Lys(R)
  MISC_FEATURE (36)..(36): Xaa represents Pro, Gly, or Lys(R)
  MISC_FEATURE (37)..(37): Xaa represents Pro, Gly, Lys(R)
  MISC_FEATURE (38)..(38): Xaa represents Pro, Gly, Lys(R)
  MISC_FEATURE (39)..(39): Xaa represents Ser, Gly, Lys(R)
YXEGTFISDYSIALDRXHQXNFVNWXLAQXXXXXXXXXX

SEQ ID NO: 11 - protein, 40 aa, Artificial Sequence
  Synthetic peptide
  MISC_FEATURE (2)..(2): Xaa represents Aib
  MISC_FEATURE (17)..(17): Xaa represents Aib
  MISC_FEATURE (20)..(20): Xaa represents Aib
  MISC_FEATURE (26)..(26): Xaa represents Iva
  MISC_FEATURE (30)..(30): Xaa represents Arg
  MISC_FEATURE (31)..(31): Xaa represents Pro, Gly, or Lys(R)
  MISC_FEATURE (32)..(32): Xaa represents Ser, Gly, or Lys(R)
  MISC_FEATURE (33)..(33): Xaa represents Ser, Gly, or Lys(R)
  MISC_FEATURE (34)..(34): Xaa represents Gly, or Lys(R)
  MISC_FEATURE (35)..(35): Xaa represents Ala, Ser, or Lys(R)
  MISC_FEATURE (36)..(36): Xaa represents Pro, or Lys(R)
  MISC_FEATURE (37)..(37): Xaa represents Pro, or Lys(R)
  MISC_FEATURE (38)..(38): Xaa represents Pro, or Lys(R)
  MISC_FEATURE (39)..(39): Xaa represents Ser, or Lys(R)
  MISC_FEATURE (40)..(40): Xaa represents Arg, or Ser
YXEGTFISDYSIALDRXHQXNFVNWXLAQXXXXXXXXXXX

SEQ ID NO: 12 - protein, 40 aa, Artificial Sequence
  Synthetic peptide
  MISC_FEATURE (2)..(2): Xaa represents for Aib
  MISC_FEATURE (13)..(13): Xaa represents for Aib
  MISC_FEATURE (20)..(20): Xaa represents for Aib
  MISC_FEATURE (40)..(40): Xaa represents for K-Eda
YXEGTVVSLYSIXLDKQAQXEFVKWLLKGGPSSGAPPPSX

SEQ ID NO: 13 - protein, 40 aa, Artificial Sequence; identical to SEQ ID NO: 12
  Synthetic peptide
  MISC_FEATURE (2)..(2): Xaa represents for Aib
  MISC_FEATURE (13)..(13): Xaa represents for Aib
  MISC_FEATURE (20)..(20): Xaa represents for Aib
  MISC_FEATURE (40)..(40): Xaa represents for K-PEG(2)-Eda

SEQ ID NO: 14 - protein, 40 aa, Artificial Sequence; identical to SEQ ID NO: 12
  Synthetic peptide
  MISC_FEATURE (2)..(2): Xaa represents for Aib
  MISC_FEATURE (13)..(13): Xaa represents for Aib
  MISC_FEATURE (20)..(20): Xaa represents for Aib
  MISC_FEATURE (40)..(40): Xaa represents for K-PEG(2)-Heda

SEQ ID NO: 15 - protein, 40 aa, Artificial Sequence; identical to SEQ ID NO: 12
  Synthetic peptide
  MISC_FEATURE (2)..(2): Xaa represents for Aib
  MISC_FEATURE (13)..(13): Xaa represents for Aib
  MISC_FEATURE (20)..(20): Xaa represents for Aib
  MISC_FEATURE (40)..(40): Xaa represents for K-PEG(2)-Oda

SEQ ID NO: 16 - protein, 40 aa, Artificial Sequence
  Synthetic peptide
  MISC_FEATURE (2)..(2): Xaa represents for Aib
  MISC_FEATURE (20)..(20): Xaa represents for Aib
  MISC_FEATURE (40)..(40): Xaa represents for K-PEG(2)-Heda
YXEGTVKSDYSILLDKQAQXEFVKWLLKGGPSSGAPPPSX

SEQ ID NO: 17 - protein, 40 aa, Artificial Sequence; identical to SEQ ID NO: 16
  Synthetic peptide
  MISC_FEATURE (2)..(2): Xaa represents for Aib
  MISC_FEATURE (20)..(20): Xaa represents for Aib
  MISC_FEATURE (40)..(40): Xaa represents for K-PEG(2)-Eda

SEQ ID NO: 18 - protein, 40 aa, Artificial Sequence; identical to SEQ ID NO: 12
  Synthetic peptide
  MISC_FEATURE (2)..(2): Xaa represents for Aib
  MISC_FEATURE (13)..(13): Xaa represents for Aib
  MISC_FEATURE (20)..(20): Xaa represents for Aib
  MISC_FEATURE (40)..(40): Xaa represents for K-GGGG-Heda

SEQ ID NO: 19 - protein, 40 aa, Artificial Sequence; identical to SEQ ID NO: 16
  Synthetic peptide
  MISC_FEATURE (2)..(2): Xaa represents for Aib
  MISC_FEATURE (20)..(20): Xaa represents for Aib
  MISC_FEATURE (40)..(40): Xaa represents for K-GGGG-Eicosanoyl

SEQ ID NO: 20 - protein, 40 aa, Artificial Sequence; identical to SEQ ID NO: 12
  Synthetic peptide
  MISC_FEATURE (2)..(2): Xaa represents for Aib
  MISC_FEATURE (13)..(13): Xaa represents for Aib
  MISC_FEATURE (20)..(20): Xaa represents for Aib
  MISC_FEATURE (40)..(40): Xaa represents for K-None-Heda

SEQ ID NO: 21 - protein, 40 aa, Artificial Sequence; identical to SEQ ID NO: 16
  Synthetic peptide
  MISC_FEATURE (2)..(2): Xaa represents for Aib
  MISC_FEATURE (20)..(20): Xaa represents for Aib
  MISC_FEATURE (40)..(40): Xaa represents for K-Pal

SEQ ID NO: 22 - protein, 40 aa, Artificial Sequence; identical to SEQ ID NO: 16
  Synthetic peptide
  MISC_FEATURE (2)..(2): Xaa represents for Aib
  MISC_FEATURE (20)..(20): Xaa represents for Aib
  MISC_FEATURE (40)..(40): Xaa represents for K-None-Heda

SEQ ID NO: 23 - protein, 40 aa, Artificial Sequence
  Synthetic peptide
  MISC_FEATURE (40)..(40): Xaa represents for K-Pal
YAEGTFISDYSIAMDKIHQQDFVNWLLAQKPSSGAPPPSX

SEQ ID NO: 24 - protein, 40 aa, Artificial Sequence; identical to SEQ ID NO: 23
  Synthetic peptide
  MISC_FEATURE (40)..(40): Xaa represents for K-Eda

SEQ ID NO: 25 - protein, 40 aa, Artificial Sequence; identical to SEQ ID NO: 23
  Synthetic peptide
  MISC_FEATURE (40)..(40): Xaa represents for K-PEG(2)-Pal

SEQ ID NO: 26 - protein, 40 aa, Artificial Sequence; identical to SEQ ID NO: 23
  Synthetic peptide
  MISC_FEATURE (40)..(40): Xaa represents for K-GGGG-Pal

SEQ ID NO: 27 - protein, 40 aa, Artificial Sequence; identical to SEQ ID NO: 23
  Synthetic peptide
  MISC_FEATURE (40)..(40): Xaa represents for K-Glu-Pal

SEQ ID NO: 28 - protein, 40 aa, Artificial Sequence; identical to SEQ ID NO: 12
  Synthetic peptide
  MISC_FEATURE (2)..(2): Xaa represents for Aib
  MISC_FEATURE (13)..(13): Xaa represents for Aib
  MISC_FEATURE (20)..(20): Xaa represents for Aib
  MISC_FEATURE (40)..(40): Xaa represents for K-Glu-Eda

SEQ ID NO: 29 - protein, 40 aa, Artificial Sequence; identical to SEQ ID NO: 16
  Synthetic peptide
  MISC_FEATURE (2)..(2): Xaa represents for Aib
  MISC_FEATURE (20)..(20): Xaa represents for Aib
  MISC_FEATURE (40)..(40): Xaa represents for K-Glu-Pal

SEQ ID NO: 30 - protein, 40 aa, Artificial Sequence; identical to SEQ ID NO: 16
  Synthetic peptide
  MISC_FEATURE (2)..(2): Xaa represents for Aib
  MISC_FEATURE (20)..(20): Xaa represents for Aib
  MISC_FEATURE (40)..(40): Xaa represents for K-Glu-Eda

SEQ ID NO: 31 - protein, 31 aa, Artificial Sequence
  Synthetic peptide
  MISC_FEATURE (2)..(2): Xaa represents for Aib
  MISC_FEATURE (13)..(13): Xaa represents for Aib
  MISC_FEATURE (20)..(20): Xaa represents for Aib
  MISC_FEATURE (31)..(31): Xaa represents for K-PEG(2)-Pal
YXEGTVVSLYSIXLDKQAQXEFVKWLLAQKX

SEQ ID NO: 32 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-(PEG3)2-Glu-Heda
YXEGTFISDYSIALDRXHQXNFVNWXLAQRPSSGAPPPSX

SEQ ID NO: 33 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-(PEG3)2-Glu-Oda

SEQ ID NO: 34 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-(PEG3)2-Glu-Eda

SEQ ID NO: 35 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGGG-Glu-Heda

SEQ ID NO: 36 - protein, 41 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Glu-Oda
YXEGTFISDYSIALDRXHQXNFVNWXLAQRPSSGAPPPSRX

SEQ ID NO: 37 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Glu-Eda

SEQ ID NO: 38 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-(PEG3)2-Glu-Heda
YXEGTXISDYSIXLDRXAQXNFVNWXLAQRPSSGAPPPSX

SEQ ID NO: 39 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-(PEG3)2-Glu-Oda

SEQ ID NO: 40 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-(PEG3)2-Glu-Eda

SEQ ID NO: 41 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGGG-Glu-Heda

SEQ ID NO: 42 - protein, 41 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Glu-Oda
YXEGTXISDYSIXLDRXAQXNFVNWXLAQRPSSGAPPPSRX

SEQ ID NO: 43 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Glu-Eda

SEQ ID NO: 44 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGG-Glu-Eda

SEQ ID NO: 45 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGGG-Glu-Eda

SEQ ID NO: 46 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-PEG(2)-Eda

SEQ ID NO: 47 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-PEG(2)-Eda

SEQ ID NO: 48 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-PEG(2)-Eda

SEQ ID NO: 49 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-PEG(2)-Eda

SEQ ID NO: 50 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-PEG(2)-Oda

SEQ ID NO: 51 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-PEG(2)-Oda

SEQ ID NO: 52 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-PEG(2)-Oda

SEQ ID NO: 53 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-PEG(2)-Oda

SEQ ID NO: 54 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-PEG(2)-Heda

SEQ ID NO: 55 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-PEG(2)-Heda

SEQ ID NO: 56 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-PEG(2)-Heda

SEQ ID NO: 57 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-PEG(2)-Heda

SEQ ID NO: 58 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Eda

SEQ ID NO: 59 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Eda

SEQ ID NO: 60 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGGG-Eda

SEQ ID NO: 61 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGGG-Eda

SEQ ID NO: 62 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Oda

SEQ ID NO: 63 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Oda

SEQ ID NO: 64 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGGG-Oda

SEQ ID NO: 65 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGGG-Oda

SEQ ID NO: 66 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Heda

SEQ ID NO: 67 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGG-Heda

SEQ ID NO: 68 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGGG-Heda

SEQ ID NO: 69 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGGG-Heda

SEQ ID NO: 70 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGG-Glu-Heda

SEQ ID NO: 71 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGG-Glu-Oda

SEQ ID NO: 72 - protein, 40 aa, Artificial Sequence; identical to SEQ ID NO: 32
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGG-Glu-Eda

SEQ ID NO: 73 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGG-Glu-Heda

SEQ ID NO: 74 - protein, 40 aa, Artificial Sequence; identical to SEQ ID NO: 38
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (40)..(40): Xaa represents for K-GGGGG-Glu-Oda

SEQ ID NO: 75 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-(PEG3)2-Glu-Heda

SEQ ID NO: 76 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-(PEG3)2-Glu-Oda

SEQ ID NO: 77 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-(PEG3)2-Glu-Eda

SEQ ID NO: 78 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-(PEG3)2-Glu-Heda

SEQ ID NO: 79 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-(PEG3)2-Glu-Oda

SEQ ID NO: 80 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-(PEG3)2-Glu-Eda

SEQ ID NO: 81 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGG-Glu-Heda

SEQ ID NO: 82 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGG-Glu-Oda

SEQ ID NO: 83 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGG-Glu-Eda

SEQ ID NO: 84 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGG-Glu-Heda

SEQ ID NO: 85 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGG-Glu-Oda

SEQ ID NO: 86 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGG-Glu-Eda

SEQ ID NO: 87 - protein, 41 aa, Artificial Sequence; identical to SEQ ID NO: 42
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGGGGG-Eda

SEQ ID NO: 88 - protein, 41 aa, Artificial Sequence; identical to SEQ ID NO: 36
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-GGGGGGGGG-Eda

SEQ ID NO: 89 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-GGGGGG-Eda
YXEGTXISDYSIXLDRXAQXNFVNWXLAQRXSSGAPPPSR

SEQ ID NO: 90 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-GGGGGG-Eda
YXEGTXISDYSIXLDRXAQXNFVNWXLAQRPXSGAPPPSR

SEQ ID NO: 91 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-GGGGGG-Eda
YXEGTXISDYSIXLDRXAQXNFVNWXLAQRPSXGAPPPSR

SEQ ID NO: 92 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-GGGGGG-Eda
YXEGTXISDYSIXLDRXAQXNFVNWXLAQRPSSXAPPPSR

SEQ ID NO: 93 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-GGGGGG-Eda
YXEGTXISDYSIXLDRXAQXNFVNWXLAQRPSSGXPPPSR

SEQ ID NO: 94 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-GGGGGG-Eda
YXEGTXISDYSIXLDRXAQXNFVNWXLAQRPSSGAXPPSR

SEQ ID NO: 95 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-GGGGGG-Eda
YXEGTXISDYSIXLDRXAQXNFVNWXLAQRPSSGAPXPSR

SEQ ID NO: 96 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-GGGGGG-Eda
YXEGTXISDYSIXLDRXAQXNFVNWXLAQRPSSGAPPXSR

SEQ ID NO: 97 - protein, 40 aa, Artificial Sequence
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-GGGGGG-Eda
YXEGTXISDYSIXLDRXAQXNFVNWXLAQRPSSGAPPPXR

SEQ ID NO: 98 - protein, 40 aa, Artificial Sequence; identical to SEQ ID NO: 89
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-GGGGGG-Oda

SEQ ID NO: 99 - protein, 40 aa, Artificial Sequence; identical to SEQ ID NO: 90
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-GGGGGG-Oda

SEQ ID NO: 100 - protein, 40 aa, Artificial Sequence; identical to SEQ ID NO: 91
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-GGGGGG-Oda

SEQ ID NO: 101 - protein, 40 aa, Artificial Sequence; identical to SEQ ID NO: 92
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-GGGGGG-Oda

SEQ ID NO: 102 - protein, 40 aa, Artificial Sequence; identical to SEQ ID NO: 93
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-GGGGGG-Oda

SEQ ID NO: 103 - protein, 40 aa, Artificial Sequence; identical to SEQ ID NO: 94
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-GGGGGG-Oda

SEQ ID NO: 104 - protein, 40 aa, Artificial Sequence; identical to SEQ ID NO: 95
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-GGGGGG-Oda

SEQ ID NO: 105 - protein, 40 aa, Artificial Sequence; identical to SEQ ID NO: 96
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-GGGGGG-Oda

SEQ ID NO: 106 - protein, 40 aa, Artificial Sequence; identical to SEQ ID NO: 97
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-GGGGGG-Oda

SEQ ID NO: 107 - protein, 40 aa, Artificial Sequence; identical to SEQ ID NO: 89
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-GGGGGG-Heda

SEQ ID NO: 108 - protein, 40 aa, Artificial Sequence; identical to SEQ ID NO: 90
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-GGGGGG-Heda

SEQ ID NO: 109 - protein, 40 aa, Artificial Sequence; identical to SEQ ID NO: 91
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-GGGGGG-Heda

SEQ ID NO: 110 - protein, 40 aa, Artificial Sequence; identical to SEQ ID NO: 92
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-GGGGGG-Heda

SEQ ID NO: 111 - protein, 40 aa, Artificial Sequence; identical to SEQ ID NO: 93
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-GGGGGG-Heda

SEQ ID NO: 112 - protein, 40 aa, Artificial Sequence; identical to SEQ ID NO: 94
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-GGGGGG-Heda

SEQ ID NO: 113 - protein, 40 aa, Artificial Sequence; identical to SEQ ID NO: 95
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-GGGGGG-Heda

SEQ ID NO: 114 - protein, 40 aa, Artificial Sequence; identical to SEQ ID NO: 96
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-GGGGGG-Heda

SEQ ID NO: 115 - protein, 40 aa, Artificial Sequence; identical to SEQ ID NO: 97
  Synthetic peptide
  MISC_FEATURE (2)..(2): Xaa represents for Aib
  MISC_FEATURE (6)..(6): Xaa represents for Iva
  MISC_FEATURE (13)..(13): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-GGGGGG-Heda

SEQ ID NO: 116 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-GGGGG-gGlu-Heda
YXEGTFISDYSIALDRXHQXNFVNWXLAQRPXSGAPPPS

SEQ ID NO: 117 - protein, 39 aa, Artificial Sequence; identical to SEQ ID NO: 116
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-GGGGG-gGlu-Oda

SEQ ID NO: 118 - protein, 39 aa, Artificial Sequence; identical to SEQ ID NO: 116
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-GGGGG-gGlu-Eda

SEQ ID NO: 119 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-GGGGG-gGlu-Heda
YXEGTFISDYSIALDRXHQXNFVNWXLAQRPSXGAPPPS

SEQ ID NO: 120 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-GGGGG-gGlu-Oda

SEQ ID NO: 121 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-GGGGG-gGlu-Eda

SEQ ID NO: 122 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-GGGGG-gGlu-Heda
YXEGTFISDYSIALDRXHQXNFVNWXLAQRPSSXAPPPS

SEQ ID NO: 123 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-GGGGG-gGlu-Oda

SEQ ID NO: 124 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-GGGGG-gGlu-Eda

SEQ ID NO: 125 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-GGGGG-gGlu-Heda
YXEGTFISDYSIALDRXHQXNFVNWXLAQRPSSGXPPPS

SEQ ID NO: 126 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-GGGGG-gGlu-Oda

SEQ ID NO: 127 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-GGGGG-gGlu-Eda

SEQ ID NO: 128 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-GGGGG-gGlu-Heda
YXEGTFISDYSIALDRXHQXNFVNWXLAQRPSSGAXPPS

SEQ ID NO: 129 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-GGGGG-gGlu-Oda

SEQ ID NO: 130 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-GGGGG-gGlu-Eda

SEQ ID NO: 131 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-GGGGG-gGlu-Heda
YXEGTFISDYSIALDRXHQXNFVNWXLAQRPSSGAPXPS

SEQ ID NO: 132 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-GGGGG-gGlu-Oda

SEQ ID NO: 133 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-GGGGG-gGlu-Eda

SEQ ID NO: 134 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-GGGGG-gGlu-Heda
YXEGTFISDYSIALDRXHQXNFVNWXLAQRPSSGAPPXS

SEQ ID NO: 135 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-GGGGG-gGlu-Oda

SEQ ID NO: 136 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-GGGGG-gGlu-Eda

SEQ ID NO: 137 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-GGGGG-gGlu-Heda
YXEGTFISDYSIALDRXHQXNFVNWXLAQRPSSGAPPPX

SEQ ID NO: 138 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-GGGGG-gGlu-Oda

SEQ ID NO: 139 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-GGGGG-gGlu-Eda

SEQ ID NO: 140 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-GGGGG-gGlu-Heda
YXEGTFISDYSIALDRXHQXNFVNWXLAQXPSSGAPPPS

SEQ ID NO: 141 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-GGGGG-gGlu-Oda

SEQ ID NO: 142 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-GGGGG-gGlu-Eda

SEQ ID NO: 143 - protein, 39 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-GGGGG-gGlu-Heda
YXEGTFISDYSIALDRXHQXNFVNWXLAQRXSSGAPPPS

SEQ ID NO: 144 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-GGGGG-gGlu-Oda

SEQ ID NO: 145 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-GGGGG-gGlu-Eda

SEQ ID NO: 146 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(PEG3)2-gGlu-Heda

SEQ ID NO: 147 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(PEG3)2-gGlu-Ida

SEQ ID NO: 148 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(PEG3)2-gGlu-Eda

SEQ ID NO: 149 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(PEG3)2-gGlu-Heda

SEQ ID NO: 150 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(PEG3)2-gGlu-Ida

SEQ ID NO: 151 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(PEG3)2-gGlu-Eda

SEQ ID NO: 152 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-(PEG3)2-gGlu-Heda

SEQ ID NO: 153 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-(PEG3)2-gGlu-Ida

SEQ ID NO: 154 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-(PEG3)2-gGlu-Eda

SEQ ID NO: 155 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(PEG3)2-gGlu-Heda

SEQ ID NO: 156 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(PEG3)2-gGlu-Ida

SEQ ID NO: 157 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(PEG3)2-gGlu-Eda

SEQ ID NO: 158 - protein, 39 aa, Artificial Sequence; identical to SEQ ID NO: 116
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(PEG3)2-gGlu-Heda

SEQ ID NO: 159 - protein, 39 aa, Artificial Sequence; identical to SEQ ID NO: 116
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(PEG3)2-gGlu-Ida

SEQ ID NO: 160 - protein, 39 aa, Artificial Sequence; identical to SEQ ID NO: 116
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(PEG3)2-gGlu-Eda

SEQ ID NO: 161 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(PEG3)2-gGlu-Heda

SEQ ID NO: 162 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(PEG3)2-gGlu-Ida

SEQ ID NO: 163 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(PEG3)2-gGlu-Eda

SEQ ID NO: 164 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(PEG3)2-gGlu-Heda

SEQ ID NO: 165 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(PEG3)2-gGlu-Ida

SEQ ID NO: 166 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(PEG3)2-gGlu-Eda

SEQ ID NO: 167 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(PEG3)2-gGlu-Heda

SEQ ID NO: 168 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(PEG3)2-gGlu-Ida

SEQ ID NO: 169 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(PEG3)2-gGlu-Eda

SEQ ID NO: 170 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3)2-gGlu-Heda

SEQ ID NO: 171 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3)2-gGlu-Ida

SEQ ID NO: 172 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3)2-gGlu-Eda

SEQ ID NO: 173 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(PEG3)2-gGlu-Heda

SEQ ID NO: 174 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(PEG3)2-gGlu-Ida

SEQ ID NO: 175 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(PEG3)2-gGlu-Eda

SEQ ID NO: 176 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-(PEG3) -gGlu-Heda

SEQ ID NO: 177 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-(PEG3)-gGlu-Oda

SEQ ID NO: 178 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-(PEG3) -gGlu-Eda

SEQ ID NO: 179 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(PEG3) -gGlu-Heda

SEQ ID NO: 180 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(PEG3)-gGlu-Oda

SEQ ID NO: 181 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(PEG3) -gGlu-Eda

SEQ ID NO: 182 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(PEG3) -gGlu-Heda
YXEGTFISDYSIALDRXHQXNFVNWXLAQRPXSGAPPPSS

SEQ ID NO: 183 - protein, 39 aa, Artificial Sequence; identical to SEQ ID NO: 116
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(PEG3)-gGlu-Oda

SEQ ID NO: 184 - protein, 39 aa, Artificial Sequence; identical to SEQ ID NO: 116
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(PEG3) -gGlu-Eda

SEQ ID NO: 185 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(PEG3) -gGlu-Heda

SEQ ID NO: 186 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(PEG3)-gGlu-Oda

SEQ ID NO: 187 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(PEG3) -gGlu-Eda

SEQ ID NO: 188 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(PEG3) -gGlu-Heda

SEQ ID NO: 189 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(PEG3)-gGlu-Oda

SEQ ID NO: 190 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(PEG3) -gGlu-Eda

SEQ ID NO: 191 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(PEG3) -gGlu-Heda

SEQ ID NO: 192 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(PEG3)-gGlu-Oda

SEQ ID NO: 193 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(PEG3) -gGlu-Eda

SEQ ID NO: 194 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3) -gGlu-Heda

SEQ ID NO: 195 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3)-gGlu-Oda

SEQ ID NO: 196 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3) -gGlu-Eda

SEQ ID NO: 197 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(PEG3) -gGlu-Heda

SEQ ID NO: 198 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(PEG3)-gGlu-Oda

SEQ ID NO: 199 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(PEG3) -gGlu-Eda

SEQ ID NO: 200 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(PEG3) -gGlu-Heda

SEQ ID NO: 201 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(PEG3)-gGlu-Oda

SEQ ID NO: 202 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(PEG3) -gGlu-Eda

SEQ ID NO: 203 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(PEG3) -gGlu-Heda

SEQ ID NO: 204 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(PEG3)-gGlu-Oda

SEQ ID NO: 205 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(PEG3) -gGlu-Eda

SEQ ID NO: 206 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-Abu-gGluOda

SEQ ID NO: 207 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-Abu-gGluOda

SEQ ID NO: 208 - protein, 39 aa, Artificial Sequence; identical to SEQ ID NO: 116
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-Abu-gGluOda

SEQ ID NO: 209 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-Abu-gGluOda

SEQ ID NO: 210 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-Abu-gGluOda

SEQ ID NO: 211 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-Abu-gGluOda

SEQ ID NO: 212 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-Abu-gGluOda

SEQ ID NO: 213 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-Abu-gGluOda

SEQ ID NO: 214 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-Abu-gGluOda

SEQ ID NO: 215 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-Abu-gGluOda

SEQ ID NO: 216 - protein, 39 aa, Artificial Sequence; identical to SEQ ID NO: 140
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (30)..(30): Xaa represents for K-(gGlu)2-Oda

SEQ ID NO: 217 - protein, 39 aa, Artificial Sequence; identical to SEQ ID NO: 143
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(gGlu)2-Oda

SEQ ID NO: 218 - protein, 39 aa, Artificial Sequence; identical to SEQ ID NO: 116
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(gGlu)2-Oda

SEQ ID NO: 219 - protein, 39 aa, Artificial Sequence; identical to SEQ ID NO: 119
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(gGlu)2-Oda

SEQ ID NO: 220 - protein, 39 aa, Artificial Sequence; identical to SEQ ID NO: 122
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(gGlu)2-Oda

SEQ ID NO: 221 - protein, 39 aa, Artificial Sequence; identical to SEQ ID NO: 125
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(gGlu)2-Oda

SEQ ID NO: 222 - protein, 39 aa, Artificial Sequence; identical to SEQ ID NO: 128
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(gGlu)2-Oda

SEQ ID NO: 223 - protein, 39 aa, Artificial Sequence; identical to SEQ ID NO: 131
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(gGlu)2-Oda

SEQ ID NO: 224 - protein, 39 aa, Artificial Sequence; identical to SEQ ID NO: 134
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(gGlu)2-Oda

SEQ ID NO: 225 - protein, 39 aa, Artificial Sequence; identical to SEQ ID NO: 137
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(gGlu)2-Oda

SEQ ID NO: 226 - protein, 40 aa, Artificial Sequence
  Synthetic peptide
  MISC_FEATURE (2)..(2): Xaa represents Aib
  MISC_FEATURE (17)..(17): Xaa represents Aib
  MISC_FEATURE (20)..(20): Xaa represents Aib
  MISC_FEATURE (26)..(26): Xaa represents Iva
  MISC_FEATURE (31)..(31): Xaa represents K-GGGGG-Heda
YXEGTFISDYSIALDRXHQXNFVNWXLAQRXSSGAPPPSR

SEQ ID NO: 227 - protein, 40 aa, Artificial Sequence; identical to SEQ ID NO: 226
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-GGGGG-Oda

SEQ ID NO: 228 - protein, 40 aa, Artificial Sequence; identical to SEQ ID NO: 226
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-GGGGG-Eda

SEQ ID NO: 229 - protein, 40 aa, Artificial Sequence; identical to SEQ ID NO: 226
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(PEG3)2-Heda

SEQ ID NO: 230 - protein, 40 aa, Artificial Sequence; identical to SEQ ID NO: 226
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(PEG3)2-Oda

SEQ ID NO: 231 - protein, 40 aa, Artificial Sequence; identical to SEQ ID NO: 226
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (31)..(31): Xaa represents for K-(PEG3)2-Eda

SEQ ID NO: 232 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(PEG3)2-Heda
YXEGTFISDYSIALDRXHQXNFVNWXLAQRPXSGAPPPSR

SEQ ID NO: 233 - protein, 40 aa, Artificial Sequence; identical to SEQ ID NO: 232
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(PEG3)2-Oda

SEQ ID NO: 234 - protein, 40 aa, Artificial Sequence; identical to SEQ ID NO: 232
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-(PEG3)2-Eda

SEQ ID NO: 235 - protein, 40 aa, Artificial Sequence; identical to SEQ ID NO: 232
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-GGGGG-Heda

SEQ ID NO: 236 - protein, 40 aa, Artificial Sequence; identical to SEQ ID NO: 232
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-GGGGG-Oda

SEQ ID NO: 237 - protein, 40 aa, Artificial Sequence; identical to SEQ ID NO: 232
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (32)..(32): Xaa represents for K-GGGGG-Eda

SEQ ID NO: 238 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-GGGGG-Heda
YXEGTFISDYSIALDRXHQXNFVNWXLAQRPSXGAPPPSR

SEQ ID NO: 239 - protein, 40 aa, Artificial Sequence; identical to SEQ ID NO: 238
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-GGGGG-Oda

SEQ ID NO: 240 - protein, 40 aa, Artificial Sequence; identical to SEQ ID NO: 238
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-GGGGG-Eda

SEQ ID NO: 241 - protein, 40 aa, Artificial Sequence; identical to SEQ ID NO: 238
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(PEG3)2-Heda

SEQ ID NO: 242 - protein, 40 aa, Artificial Sequence; identical to SEQ ID NO: 238
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(PEG3)2-Oda

SEQ ID NO: 243 - protein, 40 aa, Artificial Sequence; identical to SEQ ID NO: 238
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (33)..(33): Xaa represents for K-(PEG3)2-Eda

SEQ ID NO: 244 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-GGGGG-Heda
YXEGTFISDYSIALDRXHQXNFVNWXLAQRPSSXAPPPSR

SEQ ID NO: 245 - protein, 40 aa, Artificial Sequence; identical to SEQ ID NO: 244
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-GGGGG-Oda

SEQ ID NO: 246 - protein, 40 aa, Artificial Sequence; identical to SEQ ID NO: 244
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-GGGGG-Eda

SEQ ID NO: 247 - protein, 40 aa, Artificial Sequence; identical to SEQ ID NO: 244
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(PEG3)2-Heda

SEQ ID NO: 248 - protein, 40 aa, Artificial Sequence; identical to SEQ ID NO: 244
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(PEG3)2-Oda

SEQ ID NO: 249 - protein, 40 aa, Artificial Sequence; identical to SEQ ID NO: 244
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (34)..(34): Xaa represents for K-(PEG3)2-Eda

SEQ ID NO: 250 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(PEG3)2-Eda
YXEGTFISDYSIALDRXHQXNFVNWXLAQRPSSGXPPPSR

SEQ ID NO: 251 - protein, 40 aa, Artificial Sequence; identical to SEQ ID NO: 250
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-GGGGG-Heda

SEQ ID NO: 252 - protein, 40 aa, Artificial Sequence; identical to SEQ ID NO: 250
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-GGGGG-Oda

SEQ ID NO: 253 - protein, 40 aa, Artificial Sequence; identical to SEQ ID NO: 250
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-GGGGG-Eda

SEQ ID NO: 254 - protein, 40 aa, Artificial Sequence; identical to SEQ ID NO: 250
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(PEG3)2-Heda

SEQ ID NO: 255 - protein, 40 aa, Artificial Sequence; identical to SEQ ID NO: 250
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (35)..(35): Xaa represents for K-(PEG3)2-Oda

SEQ ID NO: 256 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-GGGGG-Heda
YXEGTFISDYSIALDRXHQXNFVNWXLAQRPSSGAXPPSR

SEQ ID NO: 257 - protein, 40 aa, Artificial Sequence; identical to SEQ ID NO: 256
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-GGGGG-Oda

SEQ ID NO: 258 - protein, 40 aa, Artificial Sequence; identical to SEQ ID NO: 256
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-GGGGG-Eda

SEQ ID NO: 259 - protein, 40 aa, Artificial Sequence; identical to SEQ ID NO: 256
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3)2-Heda

SEQ ID NO: 260 - protein, 40 aa, Artificial Sequence; identical to SEQ ID NO: 256
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3)2-Oda

SEQ ID NO: 261 - protein, 40 aa, Artificial Sequence; identical to SEQ ID NO: 256
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3)2-Eda

SEQ ID NO: 262 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-GGGGG-Heda
YXEGTFISDYSIALDRXHQXNFVNWXLAQRPSSGAPXPSR

SEQ ID NO: 263 - protein, 40 aa, Artificial Sequence; identical to SEQ ID NO: 262
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-GGGGG-Oda

SEQ ID NO: 264 - protein, 40 aa, Artificial Sequence; identical to SEQ ID NO: 262
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-GGGGG-Eda

SEQ ID NO: 265 - protein, 40 aa, Artificial Sequence; identical to SEQ ID NO: 262
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(PEG3)2-Heda

SEQ ID NO: 266 - protein, 40 aa, Artificial Sequence; identical to SEQ ID NO: 262
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(PEG3)2-Oda

SEQ ID NO: 267 - protein, 40 aa, Artificial Sequence; identical to SEQ ID NO: 262
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (37)..(37): Xaa represents for K-(PEG3)2-Eda

SEQ ID NO: 268 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-GGGGG-Heda
YXEGTFISDYSIALDRXHQXNFVNWXLAQRPSSGAPPXSR

SEQ ID NO: 269 - protein, 40 aa, Artificial Sequence; identical to SEQ ID NO: 268
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-GGGGG-Oda

SEQ ID NO: 270 - protein, 40 aa, Artificial Sequence; identical to SEQ ID NO: 268
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-GGGGG-Eda

SEQ ID NO: 271 - protein, 40 aa, Artificial Sequence; identical to SEQ ID NO: 268
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(PEG3)2-Heda

SEQ ID NO: 272 - protein, 40 aa, Artificial Sequence; identical to SEQ ID NO: 268
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(PEG3)2-Oda

SEQ ID NO: 273 - protein, 40 aa, Artificial Sequence; identical to SEQ ID NO: 268
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (38)..(38): Xaa represents for K-(PEG3)2-Eda

SEQ ID NO: 274 - protein, 40 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-GGGGG-Heda
YXEGTFISDYSIALDRXHQXNFVNWXLAQRPSSGAPPPXR

SEQ ID NO: 275 - protein, 40 aa, Artificial Sequence; identical to SEQ ID NO: 274
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-GGGGG-Oda

SEQ ID NO: 276 - protein, 40 aa, Artificial Sequence; identical to SEQ ID NO: 274
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-GGGGG-Eda

SEQ ID NO: 277 - protein, 40 aa, Artificial Sequence; identical to SEQ ID NO: 274
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(PEG3)2-Heda

SEQ ID NO: 278 - protein, 40 aa, Artificial Sequence; identical to SEQ ID NO: 274
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(PEG3)2-Oda

SEQ ID NO: 279 - protein, 40 aa, Artificial Sequence; identical to SEQ ID NO: 274
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (39)..(39): Xaa represents for K-(PEG3)2-Eda

SEQ ID NO: 280 - protein, 36 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (36)..(36): Xaa represents for K-(PEG3)2-gGlu-Oda
YXEGTFISDYSIALDRXHQXNFVNWXLAQRGGGGSX

SEQ ID NO: 281 - protein, 41 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (41)..(41): Xaa represents for K-(PEG3)2-gGlu-Oda
YXEGTFISDYSIALDRXHQXNFVNWXLAQRGGGGSGGGGSX

SEQ ID NO: 282 - protein, 46 aa, Artificial Sequence
  Synthetic peptide
  MISC_FEATURE (2)..(2): Xaa represents for Aib
  MISC_FEATURE (17)..(17): Xaa represents for Aib
  MISC_FEATURE (20)..(20): Xaa represents for Aib
  MISC_FEATURE (26)..(26): Xaa represents for Iva
  MISC_FEATURE (46)..(46): Xaa represents for K-(PEG3)2-gGlu-Oda
YXEGTFISDYSIALDRXHQXNFVNWXLAQRGGGGSGGGGSGGGGSX

SEQ ID NO: 283 - protein, 4 aa, Artificial Sequence
  Synthetic peptide
GGGG

SEQ ID NO: 284 - protein, 5 aa, Artificial Sequence
  Synthetic peptide
GGGGG

SEQ ID NO: 285 - protein, 6 aa, Artificial Sequence
  Synthetic peptide
GGGGGG

SEQ ID NO: 286 - protein, 7 aa, Artificial Sequence
  Synthetic peptide
GGGGGGG

SEQ ID NO: 287 - protein, 8 aa, Artificial Sequence
  Synthetic peptide
GGGGGGGG

SEQ ID NO: 288 - protein, 9 aa, Artificial Sequence
  Synthetic peptide
GGGGGGGGG

SEQ ID NO: 289 - protein, 6 aa, Artificial Sequence
  Synthetic peptide
  MISC_FEATURE (6)..(6): Xaa represents for gGlu
GGGGGX

SEQ ID NO: 290 - protein, 7 aa, Artificial Sequence
  Synthetic peptide
  MISC_FEATURE (7)..(7): Xaa represents for gGlu
GGGGGGX

SEQ ID NO: 291 - protein, 6 aa, Artificial Sequence
  Synthetic peptide
  MISC_FEATURE (1)..(1): Xaa represents for (PEG3)2
XGGGGG

SEQ ID NO: 292 - protein, 7 aa, Artificial Sequence
  Synthetic peptide
  MISC_FEATURE (1)..(1): Xaa represents for (PEG3)2
XGGGGGG

SEQ ID NO: 293 - protein, 6 aa, Artificial Sequence
  Synthetic peptide
  MISC_FEATURE (6)..(6): Xaa represents for gGlu-Eda
GGGGGX

SEQ ID NO: 294 - protein, 6 aa, Artificial Sequence
  Synthetic peptide
  MISC_FEATURE (6)..(6): Xaa represents for gGlu-Heda
GGGGGX

SEQ ID NO: 295 - protein, 6 aa, Artificial Sequence
  Synthetic peptide
  MISC_FEATURE (6)..(6): Xaa represents for gGlu-Oda
GGGGGX

SEQ ID NO: 296 - protein, 5 aa, Artificial Sequence
  Synthetic peptide
  MISC_FEATURE (5)..(5): Xaa represents for Gly-Heda
GGGGX

SEQ ID NO: 297 - protein, 5 aa, Artificial Sequence
  Synthetic peptide
  MISC_FEATURE (5)..(5): Xaa represents for Gly-Oda
GGGGX

SEQ ID NO: 298 - protein, 5 aa, Artificial Sequence
  Synthetic peptide
  MISC_FEATURE (5)..(5): Xaa represents for Gly-Eda
GGGGX

SEQ ID NO: 299 - protein, 4 aa, Artificial Sequence
  Synthetic peptide
  MISC_FEATURE (1)..(1): Xaa represents for Trda-Gly
XGGG

SEQ ID NO: 300 - protein, 5 aa, Artificial Sequence
  Synthetic peptide
  MISC_FEATURE (1)..(1): Xaa represents for Trda-Gly
XGGGG

SEQ ID NO: 301 - protein, 6 aa, Artificial Sequence
  Synthetic peptide
  MISC_FEATURE (1)..(1): Xaa represents for Trda-Gly
XGGGGG

SEQ ID NO: 302 - protein, 4 aa, Artificial Sequence
  Synthetic peptide
  MISC_FEATURE (1)..(1): Xaa represents for Teda-Gly
XGGG

SEQ ID NO: 303 - protein, 5 aa, Artificial Sequence
  Synthetic peptide
  MISC_FEATURE (1)..(1): Xaa represents for Teda-Gly
XGGGG

SEQ ID NO: 304 - protein, 6 aa, Artificial Sequence
  Synthetic peptide
  MISC_FEATURE (1)..(1): Xaa represents for Teda-Gly
XGGGGG

SEQ ID NO: 305 - protein, 4 aa, Artificial Sequence
  Synthetic peptide
  MISC_FEATURE (1)..(1): Xaa represents for Peda-Gly
XGGG

SEQ ID NO: 306 - protein, 5 aa, Artificial Sequence
  Synthetic peptide
  MISC_FEATURE (1)..(1): Xaa represents for Peda-Gly
XGGGG

SEQ ID NO: 307 - protein, 6 aa, Artificial Sequence
  Synthetic peptide
  MISC_FEATURE (1)..(1): Xaa represents for Peda-Gly
XGGGGG

SEQ ID NO: 308 - protein, 4 aa, Artificial Sequence
  Synthetic peptide
  MISC_FEATURE (1)..(1): Xaa represents for Heda-Gly
XGGG

SEQ ID NO: 309 - protein, 5 aa, Artificial Sequence
  Synthetic peptide
  MISC_FEATURE (1)..(1): Xaa represents for Heda-Gly
XGGGG

SEQ ID NO: 310 - protein, 6 aa, Artificial Sequence
  Synthetic peptide
  MISC_FEATURE (1)..(1): Xaa represents for Heda-Gly
XGGGGG

SEQ ID NO: 311 - protein, 4 aa, Artificial Sequence
  Synthetic peptide
  MISC_FEATURE (1)..(1): Xaa represents for Hepda-Gly
XGGG

SEQ ID NO: 312 - protein, 5 aa, Artificial Sequence
  Synthetic peptide
  MISC_FEATURE (1)..(1): Xaa represents for Hepda-Gly
XGGGG

SEQ ID NO: 313 - protein, 6 aa, Artificial Sequence
  Synthetic peptide
  MISC_FEATURE (1)..(1): Xaa represents for Hepda-Gly
XGGGGG

SEQ ID NO: 314 - protein, 4 aa, Artificial Sequence
  Synthetic peptide
  MISC_FEATURE (1)..(1): Xaa represents for Oda-Gly
XGGG

SEQ ID NO: 315 - protein, 5 aa, Artificial Sequence
  Synthetic peptide
  MISC_FEATURE (1)..(1): Xaa represents for Oda-Gly
XGGGG

SEQ ID NO: 316 - protein, 6 aa, Artificial Sequence
  Synthetic peptide
  MISC_FEATURE (1)..(1): Xaa represents for Oda-Gly
XGGGGG

SEQ ID NO: 317 - protein, 4 aa, Artificial Sequence
  Synthetic peptide
  MISC_FEATURE (1)..(1): Xaa represents for Eda-Gly
XGGG

SEQ ID NO: 318 - protein, 5 aa, Artificial Sequence
  Synthetic peptide
  MISC_FEATURE (1)..(1): Xaa represents for Eda-Gly
XGGGG

SEQ ID NO: 319 - protein, 6 aa, Artificial Sequence
  Synthetic peptide
  MISC_FEATURE (1)..(1): Xaa represents for Eda-Gly
XGGGGG

SEQ ID NO: 320 - protein, 9 aa, Artificial Sequence
  Synthetic peptide
  MISC_FEATURE (1)..(1): Xaa represents for Eda-Gly
XGGGGGGGG

SEQ ID NO: 321 - protein, 10 aa, Artificial Sequence
  Synthetic peptide
GGGGGGGGGG

SEQ ID NO: 322 - protein, 40 aa, Artificial Sequence
  Synthetic peptide
  MISC_FEATURE (1)..(1): Xaa represents for Boc-Tyr(tBu)
  MISC_FEATURE (2)..(2): Xaa represents for Aib
  MISC_FEATURE (3)..(3): Xaa represents for Glu(OtBu)
  MISC_FEATURE (5)..(5): Xaa represents for Thr(tBu)
  MISC_FEATURE (8)..(8): Xaa represents for Ser(tBu)
  MISC_FEATURE (10)..(10): Xaa represents for Tyr(tBu)
  MISC_FEATURE (11)..(11): Xaa represents for Ser(tBu)
  MISC_FEATURE (13)..(13): Xaa represents for Aib
  MISC_FEATURE (15)..(15): Xaa represents for Asp(OtBu)
  MISC_FEATURE (16)..(16): Xaa represents for Lys(boc)
  MISC_FEATURE (17)..(17): Xaa represents for Gln(Trt)
  MISC_FEATURE (19)..(19): Xaa represents for Gln(Trt)
  MISC_FEATURE (20)..(20): Xaa represents for Aib
  MISC_FEATURE (21)..(21): Xaa represents for Glu(OtBu)
  MISC_FEATURE (24)..(24): Xaa represents for Lys(Boc)
  MISC_FEATURE (25)..(25): Xaa represents for Trp(Boc)
  MISC_FEATURE (28)..(28): Xaa represents for Lys(Boc)
  MISC_FEATURE (32)..(32): Xaa represents for Ser(tBu)
  MISC_FEATURE (33)..(33): Xaa represents for Ser(tBu)
  MISC_FEATURE (39)..(39): Xaa represents for Ser(tBu)
  MISC_FEATURE (40)..(40): Xaa represents for Lys-Sieber amide resin
XXXGXVVXLXXIXLXXXAXXXFVXXLLXGGPXXGAPPPXX

SEQ ID NO: 323 - protein, 40 aa, Artificial Sequence; identical to SEQ ID NO: 322
  Synthetic peptide
  MISC_FEATURE (1)..(1): Xaa represents for Boc-Tyr(tBu)
  MISC_FEATURE (2)..(2): Xaa represents for Aib
  MISC_FEATURE (3)..(3): Xaa represents for Glu(OtBu)
  MISC_FEATURE (5)..(5): Xaa represents for Thr(tBu)
  MISC_FEATURE (8)..(8): Xaa represents for Ser(tBu)
  MISC_FEATURE (10)..(10): Xaa represents for Tyr(tBu)
  MISC_FEATURE (11)..(11): Xaa represents for Ser(tBu)
  MISC_FEATURE (13)..(13): Xaa represents for Aib
  MISC_FEATURE (15)..(15): Xaa represents for Asp(OtBu)
  MISC_FEATURE (16)..(16): Xaa represents for Lys(boc)
  MISC_FEATURE (17)..(17): Xaa represents for Gln(Trt)
  MISC_FEATURE (19)..(19): Xaa represents for Gln(Trt)
  MISC_FEATURE (20)..(20): Xaa represents for Aib
  MISC_FEATURE (21)..(21): Xaa represents for Glu(OtBu)
  MISC_FEATURE (24)..(24): Xaa represents for Lys(Boc)
  MISC_FEATURE (25)..(25): Xaa represents for Trp(Boc)
  MISC_FEATURE (28)..(28): Xaa represents for Lys(Boc)
  MISC_FEATURE (32)..(32): Xaa represents for Ser(tBu)
  MISC_FEATURE (33)..(33): Xaa represents for Ser(tBu)
  MISC_FEATURE (39)..(39): Xaa represents for Ser(tBu)
  MISC_FEATURE (40)..(40): Xaa represents for Lys(Alloc)-Sieber amide resin

SEQ ID NO: 324 - protein, 44 aa, Artificial Sequence
  Synthetic peptide
  MISC_FEATURE (1)..(1): Xaa represents for Boc-Tyr(tBu)
  MISC_FEATURE (2)..(2): Xaa represents for Aib
  MISC_FEATURE (3)..(3): Xaa represents for Glu(OtBu)
  MISC_FEATURE (5)..(5): Xaa represents for Thr(tBu)
  MISC_FEATURE (8)..(8): Xaa represents for Ser(tBu)
  MISC_FEATURE (10)..(10): Xaa represents for Tyr(tBu)
  MISC_FEATURE (11)..(11): Xaa represents for Ser(tBu)
  MISC_FEATURE (13)..(13): Xaa represents for Aib
  MISC_FEATURE (15)..(15): Xaa represents for Asp(OtBu)
  MISC_FEATURE (16)..(16): Xaa represents for Lys(boc)
  MISC_FEATURE (17)..(17): Xaa represents for Gln(Trt)
  MISC_FEATURE (19)..(19): Xaa represents for Gln(Trt)
  MISC_FEATURE (20)..(20): Xaa represents for Aib
  MISC_FEATURE (21)..(21): Xaa represents for Glu(OtBu)
  MISC_FEATURE (24)..(24): Xaa represents for Lys(Boc)
  MISC_FEATURE (25)..(25): Xaa represents for Trp(Boc)
  MISC_FEATURE (28)..(28): Xaa represents for Lys(Boc)
  MISC_FEATURE (32)..(32): Xaa represents for Ser(tBu)
  MISC_FEATURE (33)..(33): Xaa represents for Ser(tBu)
  MISC_FEATURE (39)..(39): Xaa represents for Ser(tBu)
  MISC_FEATURE (40)..(40): Xaa represents for Lys(Heda(OtBu)
XXXGXVVXLXXIXLXXXAXXXFVXXLLXGGPXXGAPPPXXGGGG

SEQ ID NO: 325 - protein, 40 aa, Artificial Sequence
  Synthetic peptide
  MISC_FEATURE (1)..(1): Xaa represents for Boc-MeTyr(tBu)
  MISC_FEATURE (2)..(2): Xaa represents for Aib
  MISC_FEATURE (3)..(3): Xaa represents for Glu(OtBu)
  MISC_FEATURE (5)..(5): Xaa represents for Thr(tBu)
  MISC_FEATURE (8)..(8): Xaa represents for Ser(tBu)
  MISC_FEATURE (9)..(9): Xaa represents for Asp(OtBu)
  MISC_FEATURE (10)..(10): Xaa represents for Tyr(tBu)
  MISC_FEATURE (11)..(11): Xaa represents for Ser(tBu)
  MISC_FEATURE (15)..(15): Xaa represents for Asp(OtBu)
  MISC_FEATURE (16)..(16): Xaa represents for Arg(Pbf)
  MISC_FEATURE (17)..(17): Xaa represents for Aib
  MISC_FEATURE (18)..(18): Xaa represents for His(Trt)
  MISC_FEATURE (19)..(19): Xaa represents for Gln(Trt)
  MISC_FEATURE (20)..(20): Xaa represents for Aib
  MISC_FEATURE (21)..(21): Xaa represents for Asn(Trt)
  MISC_FEATURE (24)..(24): Xaa represents for Asn(Trt)
  MISC_FEATURE (25)..(25): Xaa represents for Trp(Boc)
  MISC_FEATURE (26)..(26): Xaa represents for Iva
  MISC_FEATURE (29)..(29): Xaa represents for Gln(Trt)
  MISC_FEATURE (30)..(30): Xaa represents for Arg(Pbf)
  MISC_FEATURE (32)..(32): Xaa represents for Ser(tBu)
  MISC_FEATURE (33)..(33): Xaa represents for Ser(tBu)
  MISC_FEATURE (39)..(39): Xaa represents for Ser(tBu)
XXXGXFIXXXXIALXXXAXXXFVXXXLAXXPXXGAPPPXK

SEQ ID NO: 326 - protein, 40 aa, Artificial Sequence
  Synthetic peptide
  MISC_FEATURE (1)..(1): Xaa represents for Boc-MeTyr(tBu)
  MISC_FEATURE (2)..(2): Xaa represents for Aib
  MISC_FEATURE (3)..(3): Xaa represents for Glu(OtBu)
  MISC_FEATURE (5)..(5): Xaa represents for Thr(tBu)
  MISC_FEATURE (8)..(8): Xaa represents for Ser(tBu)
  MISC_FEATURE (9)..(9): Xaa represents for Asp(OtBu)
  MISC_FEATURE (10)..(10): Xaa represents for Tyr(tBu)
  MISC_FEATURE (11)..(11): Xaa represents for Ser(tBu)
  MISC_FEATURE (15)..(15): Xaa represents for Asp(OtBu)
  MISC_FEATURE (16)..(16): Xaa represents for Arg(Pbf)
  MISC_FEATURE (17)..(17): Xaa represents for Aib
  MISC_FEATURE (18)..(18): Xaa represents for His(Trt)
  MISC_FEATURE (19)..(19): Xaa represents for Gln(Trt)
  MISC_FEATURE (20)..(20): Xaa represents for Aib
  MISC_FEATURE (21)..(21): Xaa represents for Asn(Trt)
  MISC_FEATURE (24)..(24): Xaa represents for Asn(Trt)
  MISC_FEATURE (25)..(25): Xaa represents for Trp(Boc)
  MISC_FEATURE (26)..(26): Xaa represents for Iva
  MISC_FEATURE (29)..(29): Xaa represents for Gln(Trt)
  MISC_FEATURE (30)..(30): Xaa represents for Arg(Pbf)
  MISC_FEATURE (32)..(32): Xaa represents for Ser(tBu)
  MISC_FEATURE (33)..(33): Xaa represents for Ser(tBu)
  MISC_FEATURE (39)..(39): Xaa represents for Ser(tBu)
  MISC_FEATURE (40)..(40): Xaa represents for Lys(ivDde)
XXXGXFIXXXXIALXXXAXXXFVXXXLAXXPXXGAPPPXX

SEQ ID NO: 327 - protein, 40 aa, Artificial Sequence; identical to SEQ ID NO: 326
  Synthetic peptide
  MISC_FEATURE (1)..(1): Xaa represents for Boc-MeTyr(tBu)
  MISC_FEATURE (2)..(2): Xaa represents for Aib
  MISC_FEATURE (3)..(3): Xaa represents for Glu(OtBu)
  MISC_FEATURE (5)..(5): Xaa represents for Thr(tBu)
  MISC_FEATURE (8)..(8): Xaa represents for Ser(tBu)
  MISC_FEATURE (9)..(9): Xaa represents for Asp(OtBu)
  MISC_FEATURE (10)..(10): Xaa represents for Tyr(tBu)
  MISC_FEATURE (11)..(11): Xaa represents for Ser(tBu)
  MISC_FEATURE (15)..(15): Xaa represents for Asp(OtBu)
  MISC_FEATURE (16)..(16): Xaa represents for Arg(Pbf)
  MISC_FEATURE (17)..(17): Xaa represents for Aib
  MISC_FEATURE (18)..(18): Xaa represents for His(Trt)
  MISC_FEATURE (19)..(19): Xaa represents for Gln(Trt)
  MISC_FEATURE (20)..(20): Xaa represents for Aib
  MISC_FEATURE (21)..(21): Xaa represents for Asn(Trt)
  MISC_FEATURE (24)..(24): Xaa represents for Asn(Trt)
  MISC_FEATURE (25)..(25): Xaa represents for Trp(Boc)
  MISC_FEATURE (26)..(26): Xaa represents for Iva
  MISC_FEATURE (29)..(29): Xaa represents for Gln(Trt)
  MISC_FEATURE (30)..(30): Xaa represents for Arg(Pbf)
  MISC_FEATURE (32)..(32): Xaa represents for Ser(tBu)
  MISC_FEATURE (33)..(33): Xaa represents for Ser(tBu)
  MISC_FEATURE (39)..(39): Xaa represents for Ser(tBu)
  MISC_FEATURE (40)..(40): Xaa represents for K-(Oda-GGGGG)

SEQ ID NO: 328 - protein, 20 aa, Artificial Sequence
  Synthetic Peptide (Reference Example 1)
EFVKWLLKGGPSSGAPPPSK

SEQ ID NO: 329 - protein, 28 aa, Artificial Sequence
  Synthetic Peptide (Reference Example 2)
  MISC_FEATURE (1)..(1): Xaa stands for Aib
  MISC_FEATURE (8)..(8): Xaa stands for Aib
  MISC_FEATURE (14)..(14): Xaa stands for Aib
XLDKQAQXEFVKWXLKGGPSSGAPPPSK

SEQ ID NO: 330 - protein, 10 aa, Artificial Sequence
  Synthetic Peptide (Reference Example 3)
PSSGAPPPSR

SEQ ID NO: 331 - protein, 40 aa, Artificial Sequence
  Synthetic Peptide (Compound 1)
  MISC_FEATURE (2)..(2): Xaa stands for Aib
  MISC_FEATURE (20)..(20): Xaa stands for Aib
YXEGTVISDYSIYLDKQAQXEFVKWLLKGGPSSGAPPPSK

SEQ ID NO: 332 - protein, 40 aa, Artificial Sequence
  Synthetic Peptide (Compound 2)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVISDYSIXLDKQAQXEFVKWLLKGGPSSGAPPPSK

SEQ ID NO: 333 - protein, 40 aa, Artificial Sequence
  Synthetic Peptide (Compound 3)
  MISC_FEATURE (2)..(2): Xaa stands for Aib
  MISC_FEATURE (20)..(20): Xaa stands for Aib
YXEGTVVSDYSIYLDKQAQXEFVKWLLKGGPSSGAPPPSK

SEQ ID NO: 334 - protein, 40 aa, Artificial Sequence
  Synthetic Peptide (Compound 4)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSDYSIXLDKQAQXEFVKWLLKGGPSSGAPPPSK

SEQ ID NO: 335 - protein, 40 aa, Artificial Sequence
  Synthetic Peptide (Compound 5)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSDYSIXLKKQAQXEFVKWLLKGGPSSGAPPPSK

SEQ ID NO: 336 - protein, 40 aa, Artificial Sequence
  Synthetic Peptide (Compound 6)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXEFVKWLLKGGPSSGAPPPSK

SEQ ID NO: 337 - protein, 40 aa, Artificial Sequence
  Synthetic Peptide (Compound 7)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSFYSIXLDKQAQXEFVKWLLKGGPSSGAPPPSK

SEQ ID NO: 338 - protein, 40 aa, Artificial Sequence
  Synthetic Peptide (Compound 8)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVKSDYSIXLDKQAQXEFVKWLLKGGPSSGAPPPSK

SEQ ID NO: 339 - protein, 40 aa, Artificial Sequence
  Synthetic Peptide (Compound 9)
  MISC_FEATURE (2)..(2): Xaa stands for Aib
  MISC_FEATURE (20)..(20): Xaa stands for Aib
YXEGTVKSDYSIQLDKQAQXEFVKWLLKGGPSSGAPPPSK

SEQ ID NO: 340 - protein, 40 aa, Artificial Sequence
  Synthetic Peptide (Compound 10)
  MISC_FEATURE (2)..(2): Xaa stands for Aib
  MISC_FEATURE (20)..(20): Xaa stands for Aib
YXEGTVKSDYSILLDKQAQXEFVKWLLKGGPSSGAPPPSK

SEQ ID NO: 341 - protein, 40 aa, Artificial Sequence; identical to SEQ ID NO: 336
  Synthetic Peptide (Compound 11)
  MISC_FEATURE (1)..(1): N-terminal Acetylation
  MISC_FEATURE (2)..(2): Xaa stands for Aib
  MISC_FEATURE (13)..(13): Xaa stands for Aib
  MISC_FEATURE (20)..(20): Xaa stands for Aib

SEQ ID NO: 342 - protein, 40 aa, Artificial Sequence; identical to SEQ ID NO: 340
  Synthetic Peptide (Compound 12)
  MISC_FEATURE (1)..(1): N-terminal Acetylation
  MISC_FEATURE (2)..(2): Xaa stands for Aib
  MISC_FEATURE (20)..(20): Xaa stands for Aib

SEQ ID NO: 343 - protein, 40 aa, Artificial Sequence; identical to SEQ ID NO: 336
  Synthetic Peptide (Compound 13)
  MISC_FEATURE (1)..(1): N-terminal Methylation
  MISC_FEATURE (2)..(2): Xaa stands for Aib
  MISC_FEATURE (13)..(13): Xaa stands for Aib
  MISC_FEATURE (20)..(20): Xaa stands for Aib

SEQ ID NO: 344 - protein, 40 aa, Artificial Sequence; identical to SEQ ID NO: 340
  Synthetic Peptide (Compound 14)
  MISC_FEATURE (1)..(1): N-terminal Methylation
  MISC_FEATURE (2)..(2): Xaa stands for Aib
  MISC_FEATURE (20)..(20): Xaa stands for Aib

SEQ ID NO: 345 - protein, 40 aa, Artificial Sequence
  Synthetic Peptide (Compound 15)
  MISC_FEATURE (2)..(2): D-Alanine
  MISC_FEATURE (20)..(20): Xaa stands for Aib
YAEGTVVSLYSIALDKQAQXEFVKWLLKGGPSSGAPPPSK

SEQ ID NO: 346 - protein, 40 aa, Artificial Sequence
  Synthetic Peptide (Compound 16)
  MISC_FEATURE (2)..(2): D-Alanine
  MISC_FEATURE (13)..(13): Xaa stands for Aib
  MISC_FEATURE (20)..(20): Xaa stands for Aib
YAEGTVVSLYSIXLDKQHQXEFVKWLLKGGPSSGAPPPSK

SEQ ID NO: 347 - protein, 40 aa, Artificial Sequence
  Synthetic Peptide (Compound 17)
  MISC_FEATURE (2)..(2): D-Alanine
  MISC_FEATURE (13)..(13): Xaa stands for Aib
  MISC_FEATURE (20)..(20): Xaa stands for Aib
YAEGTVVSLYSIXLYKQHQXEFVKWLLKGGPSSGAPPPSK

SEQ ID NO: 348 - protein, 40 aa, Artificial Sequence
  Synthetic Peptide (Compound 18)
  MISC_FEATURE (2)..(2): D-Alanine
  MISC_FEATURE (13)..(13): D-Alanine
YAEGTVVSLYSIXLDKQHQQEFVKWLLKGGPSSGAPPPSK

SEQ ID NO: 349 - protein, 40 aa, Artificial Sequence
  Synthetic Peptide (Compound 19)
  MISC_FEATURE (2)..(2): D-Alanine
  MISC_FEATURE (13)..(13): Xaa stands for Aib
  MISC_FEATURE (20)..(20): Xaa stands for Aib
YAEGTVVSLYSIXLDKIHQXEFVKWLLKGGPSSGAPPPSK

SEQ ID NO: 350 - protein, 40 aa, Artificial Sequence
  Synthetic Peptide (Compound 20)
  MISC_FEATURE (2)..(2): D-Alanine
  MISC_FEATURE (13)..(13): D-Alanine
YAEGTVVSLYSIXLDKIHQQEFVKWLLKGGPSSGAPPPSK

SEQ ID NO: 351 - protein, 40 aa, Artificial Sequence
  Synthetic Peptide (Compound 21)
  MISC_FEATURE (2)..(2): D-Alanine
  MISC_FEATURE (13)..(13): D-Alanine
YAEGTVVSLYSIXLYKIHQQEFVKWLLKGGPSSGAPPPSK

SEQ ID NO: 352 - protein, 40 aa, Artificial Sequence
  Synthetic Peptide (Compound 22)
  MISC_FEATURE (2)..(2): D-Alanine
  MISC_FEATURE (20)..(20): Xaa stands for Aib
YAEGTVVSLYSIALDKQHQXEFVKWLLKGGPSSGAPPPSK

SEQ ID NO: 353 - protein, 40 aa, Artificial Sequence
  Synthetic Peptide (Compound 23)
  MISC_FEATURE (2)..(2): D-Alanine
  MISC_FEATURE (20)..(20): Xaa stands for Aib
YAEGTVVSLYSIALDKIHQXEFVKWLLKGGPSSGAPPPSK

SEQ ID NO: 354 - protein, 40 aa, Artificial Sequence
  Synthetic Peptide (Compound 24)
  MISC_FEATURE (2)..(2): D-Alanine
YAEGTVVSLYSIALDKQHQQEFVKWLLKGGPSSGAPPPSK

SEQ ID NO: 355 - protein, 40 aa, Artificial Sequence
  Synthetic Peptide (Compound 25)
  MISC_FEATURE (2)..(2): D-Alanine
YAEGTVVSLYSIALDKIHQQEFVKWLLKGGPSSGAPPPSK

SEQ ID NO: 356 - protein, 40 aa, Artificial Sequence
  Synthetic Peptide (Compound 26)
  MISC_FEATURE (2)..(2): D-Alanine
YAEGTVVSLYSIALYKIHQQEFVKWLLKGGPSSGAPPPSK

SEQ ID NO: 357 - protein, 40 aa, Artificial Sequence
  Synthetic Peptide (Compound 27)
  MISC_FEATURE (2)..(2): D-Alanine
  MISC_FEATURE (13)..(13): Xaa stands for Aib
  MISC_FEATURE (20)..(20): Xaa stands for Aib
YAEGTVVSLYSIXLDKQAQXEFVKWLLKGGPSSGAPPPSK

SEQ ID NO: 358 - protein, 40 aa, Artificial Sequence; identical to SEQ ID NO: 357
  Synthetic Peptide (Compound 28)
  MISC_FEATURE (2)..(2): D-Alanine
  MISC_FEATURE (13)..(13): Xaa stands for Aib
  MISC_FEATURE (20)..(20): Xaa stands for Aib

SEQ ID NO: 359 - protein, 40 aa, Artificial Sequence
  Synthetic Peptide (Compound 29)
  MISC_FEATURE (2)..(2)
  MISC_FEATURE (13)..(13)
  MISC_FEATURE (20)..(20)
YXEGTVVSLYSIXLDKQHQXEFVKWLLKGGPSSGAPPPSK

SEQ ID NO: 360 - protein, 40 aa, Artificial Sequence
  Synthetic Peptide (Compound 30)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDRQAQXEFVRWLLRGGPSSGAPPPSR

SEQ ID NO: 361 - protein, 39 aa, Artificial Sequence
  Synthetic Peptide (Compound 31)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXEFVKWLLKGGPSSGAPPPK

SEQ ID NO: 362 - protein, 40 aa, Artificial Sequence
  Synthetic Peptide (Compound 32)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVISLYSIXLDKQAQXEFVKWLLKGGPSSGAPPPSK

SEQ ID NO: 363 - protein, 40 aa, Artificial Sequence
  Synthetic Peptide (Compound 33)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKQAQXEFVKWLLKGGPSSGAPPPSK

SEQ ID NO: 364 - protein, 40 aa, Artificial Sequence
  Synthetic Peptide (Compound 34)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLSKQAQXEFVKWLLKGGPSSGAPPPSK

SEQ ID NO: 365 - protein, 40 aa, Artificial Sequence
  Synthetic Peptide (Compound 35)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKIAQXEFVKWLLKGGPSSGAPPPSK

SEQ ID NO: 366 - protein, 40 aa, Artificial Sequence
  Synthetic Peptide (Compound 36)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQASXEFVKWLLKGGPSSGAPPPSK

SEQ ID NO: 367 - protein, 40 aa, Artificial Sequence
  Synthetic Peptide (Compound 37)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXLFVKWLLKGGPSSGAPPPSK

SEQ ID NO: 368 - protein, 40 aa, Artificial Sequence
  Synthetic Peptide (Compound 38)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXEFIKWLLKGGPSSGAPPPSK

SEQ ID NO: 369 - protein, 40 aa, Artificial Sequence; identical to SEQ ID NO: 336
  Synthetic Peptide (Compound 39)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (24)..(24): Acetylation

SEQ ID NO: 370 - protein, 39 aa, Artificial Sequence
  Synthetic Peptide (Compound 40)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXEFVKWLLKGGPSSGAPPPS

SEQ ID NO: 371 - protein, 40 aa, Artificial Sequence; identical to SEQ ID NO: 336
  Synthetic Peptide (Compound 41)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (28)..(28): Acetylation

SEQ ID NO: 372 - protein, 40 aa, Artificial Sequence
  Synthetic Peptide (Compound 42)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (26)..(26): Xaa stands for Aib
YXEGTVVSLYSIXLDKQAQXEFVKWXLKGGPSSGAPPPSK

SEQ ID NO: 373 - protein, 40 aa, Artificial Sequence; identical to SEQ ID NO: 334
  Synthetic Peptide (Compound 43)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (28)..(28): Acetylation

SEQ ID NO: 374 - protein, 40 aa, Artificial Sequence
  Synthetic Peptide (Compound 44)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (26)..(26): Xaa stands for Aib
YXEGTVVSDYSIXLDKQAQXEFVKWXLKGGPSSGAPPPSK

SEQ ID NO: 375 - protein, 40 aa, Artificial Sequence
  Synthetic Peptide (Compound 45)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVISLYSIXLEKQAQXEFVKWLLKGGPSSGAPPPSK

SEQ ID NO: 376 - protein, 40 aa, Artificial Sequence
  Synthetic Peptide (Compound 46)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKIAQXEFVKWLLKGGPSSGAPPPSK

SEQ ID NO: 377 - protein, 40 aa, Artificial Sequence
  Synthetic Peptide (Compound 47)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKQHQXEFVKWLLKGGPSSGAPPPSK

SEQ ID NO: 378 - protein, 40 aa, Artificial Sequence
  Synthetic Peptide (Compound 48)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKQASXEFVKWLLKGGPSSGAPPPSK

SEQ ID NO: 379 - protein, 40 aa, Artificial Sequence
  Synthetic Peptide (Compound 49)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKQAQXEFIKWLLKGGPSSGAPPPSK

SEQ ID NO: 380 - protein, 40 aa, Artificial Sequence; identical to SEQ ID NO: 363
  Synthetic Peptide (Compound 50)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (24)..(24): Acetylation

SEQ ID NO: 381 - protein, 40 aa, Artificial Sequence
  Synthetic Peptide (Compound 51)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVISLYSIXLEKQAQXEFIKWLLKGGPSSGAPPPSK

SEQ ID NO: 382 - protein, 39 aa, Artificial Sequence; identical to SEQ ID NO: 370
  Synthetic Peptide (Compound 52)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (28)..(28): Acetylation

SEQ ID NO: 383 - protein, 39 aa, Artificial Sequence
  Synthetic Peptide (Compound 53)
  MISC_FEATURE (1)..(1): N-terminal Methylation
  MISC_FEATURE (2)..(2): Xaa stands for Aib
  MISC_FEATURE (20)..(20): Xaa stands for Aib
YXEGTFISDYSIALDRIHQXNFVNWLLAQRPSSGAPPPS

SEQ ID NO: 384 - protein, 39 aa, Artificial Sequence
  Synthetic Peptide (Compound 54)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDRQAQXEFVRWLLRGGPSSGAPPPS

SEQ ID NO: 385 - protein, 40 aa, Artificial Sequence
  Synthetic Peptide (Compound 55)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDRQAQXEFVRWLLAQRPSSGAPPPSR

SEQ ID NO: 386 - protein, 39 aa, Artificial Sequence
  Synthetic Peptide (Compound 56)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDRQAQXEFVRWLLAQRPSSGAPPPS

SEQ ID NO: 387 - protein, 40 aa, Artificial Sequence
  Synthetic Peptide (Compound 57)
  MISC_FEATURE (2)..(2): Xaa stands for Aib
  MISC_FEATURE (11)..(11): Xaa stands for Aib
  MISC_FEATURE (13)..(13): Xaa stands for Aib
  MISC_FEATURE (20)..(20): Xaa stands for Aib
YXEGTVVSLYXIXLDRQAQXEFVRWLLRGGPSSGAPPPSR

SEQ ID NO: 388 - protein, 40 aa, Artificial Sequence
  Synthetic Peptide (Compound 58)
  MISC_FEATURE (2)..(2): Xaa stands for Aib
  MISC_FEATURE (13)..(13): Xaa stands for Aib
YXEGTVVSLYSIXLDRQAQAEFVRWLLRGGPSSGAPPPSR

SEQ ID NO: 389 - protein, 40 aa, Artificial Sequence
  Synthetic Peptide (Compound 59)
  MISC_FEATURE (1)..(1): N-terminal Methylation
  MISC_FEATURE (2)..(2): Xaa stands for Aib
YXEGTFISDYSIALDRIAQQDFVNWLLAQRPSSGAPPPSR

SEQ ID NO: 390 - protein, 40 aa, Artificial Sequence
  Synthetic Peptide (Compound 60)
  MISC_FEATURE (1)..(1): N-terminal Methylation
  MISC_FEATURE (2)..(2): Xaa stands for Aib
YXEGTFISDYSIALDRIAQQSFVNWLLAQRPSSGAPPPSR

SEQ ID NO: 391 - protein, 39 aa, Artificial Sequence
  Synthetic Peptide (Compound 61)
  MISC_FEATURE (1)..(1): N-terminal Methylation
  MISC_FEATURE (2)..(2): Xaa stands for Aib
  MISC_FEATURE (26)..(26): Xaa stands for Iva
YXEGTFISDYSIALDRIAQQDFVNWXLAQRPSSGAPPPS

SEQ ID NO: 392 - protein, 39 aa, Artificial Sequence
  Synthetic Peptide (Compound 62)
  MISC_FEATURE (1)..(1): N-terminal Methylation
  MISC_FEATURE (2)..(2): Xaa stands for Aib
  MISC_FEATURE (22)..(22): alpha-Methylation
YXEGTFISDYSIALDRIAQQDFVNWLLAQRPSSGAPPPS

SEQ ID NO: 393 - protein, 39 aa, Artificial Sequence
  Synthetic Peptide (Compound 63)
  MISC_FEATURE (1)..(1): N-terminal Methylation
  MISC_FEATURE (2)..(2): Xaa stands for Aib
  MISC_FEATURE (13)..(13): Xaa stands for D-Iva
YXEGTFISDYSIXLDRIAQQDFVNWLLAQRPSSGAPPPS

SEQ ID NO: 394 - protein, 39 aa, Artificial Sequence
  Synthetic Peptide (Compound 64)
  MISC_FEATURE (1)..(1): N-terminal Methylation
  MISC_FEATURE (2)..(2): Xaa stands for Aib
  MISC_FEATURE (6)..(6): Xaa stands for Iva
YXEGTXISDYSIALDRIAQQDFVNWLLAQRPSSGAPPPS

SEQ ID NO: 395 - protein, 40 aa, Artificial Sequence; identical to SEQ ID NO: 389
  Synthetic Peptide (Compound 65)
  MISC_FEATURE (1)..(1): N-terminal Methylation
  MISC_FEATURE (2)..(2): Xaa stands for Aib
  MISC_FEATURE (22)..(22): alpha-Methylation

SEQ ID NO: 396 - protein, 40 aa, Artificial Sequence
  Synthetic Peptide (Compound 66)
  MISC_FEATURE (1)..(1): N-terminal Methylation
  MISC_FEATURE (2)..(2): Xaa stands for Aib
  MISC_FEATURE (22)..(22): alpha-Methylation
  MISC_FEATURE (26)..(26): Xaa stands for Iva
YXEGTFISDYSIALDRIAQQDFVNWXLAQRPSSGAPPPSR

SEQ ID NO: 397 - protein, 40 aa, Artificial Sequence
  Synthetic Peptide (Compound 67)
  MISC_FEATURE (1)..(1): N-terminal Methylation
  MISC_FEATURE (2)..(2): Xaa stands for Aib
  MISC_FEATURE (26)..(26): Xaa stands for Iva
YXEGTFISDYSIALDRIAQQSFVNWXLAQRPSSGAPPPSR

SEQ ID NO: 398 - protein, 40 aa, Artificial Sequence
  Synthetic Peptide (Compound 68)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (26)..(26): Xaa stands for Iva
YXEGTFISDYSIALDRIAQXNFVNWXLAQRPSSGAPPPSR

SEQ ID NO: 399 - protein, 40 aa, Artificial Sequence
  Synthetic Peptide (Compound 69)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (26)..(26): Xaa stands for Iva
YXEGTFISDYSIALDRXAQQDFVNWXLAQRPSSGAPPPSR

SEQ ID NO: 400 - protein, 40 aa, Artificial Sequence
  Synthetic Peptide (Compound 70)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (26)..(26): Xaa stands for Iva
YXEGTFISDYSIXLDRIAQQDFVNWXLAQRPSSGAPPPSR

SEQ ID NO: 401 - protein, 40 aa, Artificial Sequence; identical to SEQ ID NO: 390
  Synthetic Peptide (Compound 71)
  MISC_FEATURE (1)..(1): N-terminal Methylation
  MISC_FEATURE (2)..(2): Xaa stands for Aib
  MISC_FEATURE (22)..(22): alpha-Methylation

SEQ ID NO: 402 - protein, 40 aa, Artificial Sequence
  Synthetic Peptide (Compound 72)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (22)..(22): alpha-Methylation
YXEGTFISDYSIALDRIAQXNFVNWLLAQRPSSGAPPPSR

SEQ ID NO: 403 - protein, 40 aa, Artificial Sequence
  Synthetic Peptide (Compound 73)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (22)..(22): alpha-Methylation
YXEGTFISDYSIALDRXAQQDFVNWLLAQRPSSGAPPPSR

SEQ ID NO: 404 - protein, 40 aa, Artificial Sequence
  Synthetic Peptide (Compound 74)
  MISC_FEATURE (1)..(1): N-terminal Methylation
  MISC_FEATURE (2)..(2): Xaa stands for Aib
  MISC_FEATURE (13)..(13): Xaa stands for Iva
  MISC_FEATURE (22)..(22): alpha-Methylation
YXEGTFISDYSIXLDRIAQQDFVNWLLAQRPSSGAPPPSR

SEQ ID NO: 405 - protein, 40 aa, Artificial Sequence; identical to SEQ ID NO: 397
  Synthetic Peptide (Compound 75)
  MISC_FEATURE (1)..(1): N-terminal Methylation
  MISC_FEATURE (2)..(2): Xaa stands for Aib
  MISC_FEATURE (22)..(22): alpha-Methylation
  MISC_FEATURE (26)..(26): Xaa stands for Iva

SEQ ID NO: 406 - protein, 40 aa, Artificial Sequence; identical to SEQ ID NO: 398
  Synthetic Peptide (Compound 76)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 407 - protein, 40 aa, Artificial Sequence; identical to SEQ ID NO: 399
  Synthetic Peptide (Compound 77)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (22)..(22): alpha-Methylation
  MISC_FEATURE (26)..(26): Xaa stands for Iva

SEQ ID NO: 408 - protein, 40 aa, Artificial Sequence; identical to SEQ ID NO: 400
  Synthetic Peptide (Compound 78)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (22)..(22): alpha-Methylation
  MISC_FEATURE (26)..(26): Xaa stands for Iva

SEQ ID NO: 409 - protein, 40 aa, Artificial Sequence
  Synthetic Peptide (Compound 79)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
YXEGTFISDYSIXLDRXAQQDFVNWLLAQRPSSGAPPPSR

SEQ ID NO: 410 - protein, 40 aa, Artificial Sequence
  Synthetic Peptide (Compound 80)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
YXEGTXISDYSIXLDRIAQQDFVNWLLAQRPSSGAPPPSR

SEQ ID NO: 411 - protein, 40 aa, Artificial Sequence; identical to SEQ ID NO: 409
  Synthetic Peptide (Compound 81)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
  MISC_FEATURE (22)..(22): alpha-Methylation

SEQ ID NO: 412 - protein, 40 aa, Artificial Sequence
  Synthetic Peptide (Compound 82)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
YXEGTFISDYSIALDRXAQXNFVNWLLAQRPSSGAPPPSR

SEQ ID NO: 413 - protein, 40 aa, Artificial Sequence
  Synthetic Peptide (Compound 83)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (20)..(20): Xaa stands for Aib
YXEGTFISDYSIXLDRIAQXNFVNWLLAQRPSSGAPPPSR

SEQ ID NO: 414 - protein, 40 aa, Artificial Sequence
  Synthetic Peptide (Compound 84)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIALDRXAQXNFVNWXLAQRPSSGAPPPSR

SEQ ID NO: 415 - protein, 40 aa, Artificial Sequence
  Synthetic Peptide (Compound 85)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIXLDRXAQXNFVNWXLAQRPSSGAPPPSR

SEQ ID NO: 416 - protein, 40 aa, Artificial Sequence
  Synthetic Peptide (Compound 86)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (22)..(22): alpha-Methylation
  MISC_FEATURE (26)..(26): Xaa stands for Iva
YXEGTXISDYSIXLDRXAQQDFVNWXLAQRPSSGAPPPSR

SEQ ID NO: 417 - protein, 40 aa, Artificial Sequence
  Synthetic Peptide (Compound 87)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXLDRXAQXNFVNWXLAQRPSSGAPPPSR

SEQ ID NO: 418 - protein, 40 aa, Artificial Sequence
  Synthetic Peptide (Compound 88)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (26)..(26): Xaa stands for Iva
YXEGTXISDYSIALDRIAQQDFVNWXLAQRPSSGAPPPSR

SEQ ID NO: 419 - protein, 40 aa, Artificial Sequence
  Synthetic Peptide (Compound 89)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (22)..(22): alpha-Methylation
YXEGTXISDYSIALDRIAQQDFVNWLLAQRPSSGAPPPSR

SEQ ID NO: 420 - protein, 40 aa, Artificial Sequence
  Synthetic Peptide (Compound 90)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (20)..(20): Xaa stands for Aib
YXEGTXISDYSIALDRIAQXNFVNWLLAQRPSSGAPPPSR

SEQ ID NO: 421 - protein, 40 aa, Artificial Sequence
  Synthetic Peptide (Compound 91)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
YXEGTXISDYSIALDRXAQQDFVNWLLAQRPSSGAPPPSR

SEQ ID NO: 422 - protein, 40 aa, Artificial Sequence
  Synthetic Peptide (Compound 92)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (20)..(20): Xaa stands for Aib
  MISC_FEATURE (26)..(26): Xaa stands for Iva
YXEGTFISDYSIXLDRIAQXNFVNWXLAQRPSSGAPPPSR

SEQ ID NO: 423 - protein, 40 aa, Artificial Sequence
  Synthetic Peptide (Compound 93)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
  MISC_FEATURE (26)..(26): Xaa stands for D-Iva
YXEGTFISDYSIXLDRXAQQDFVNWXLAQRPSSGAPPPSR

SEQ ID NO: 424 - protein, 40 aa, Artificial Sequence
  Synthetic Peptide (Compound 94)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (26)..(26): Xaa stands for Iva
YXEGTXISDYSIXLDRIAQQDFVNWXLAQRPSSGAPPPSR

SEQ ID NO: 425 - protein, 40 aa, Artificial Sequence; identical to SEQ ID NO: 418
  Synthetic Peptide (Compound 95)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (22)..(22): alpha-Methylation
  MISC_FEATURE (26)..(26): Xaa stands for Iva

SEQ ID NO: 426 - protein, 40 aa, Artificial Sequence
  Synthetic Peptide (Compound 96)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (20)..(20): Xaa stands for Aib
  MISC_FEATURE (26)..(26): Xaa stands for Iva
YXEGTXISDYSIALDRIAQXNFVNWXLAQRPSSGAPPPSR

SEQ ID NO: 427 - protein, 40 aa, Artificial Sequence
  Synthetic Peptide (Compound 97)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (26)..(26): Xaa stands for Iva
YXEGTXISDYSIALDRXAQQDFVNWXLAQRPSSGAPPPSR

SEQ ID NO: 428 - protein, 40 aa, Artificial Sequence; identical to SEQ ID NO: 412
  Synthetic Peptide (Compound 98)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (22)..(22): alpha-Methylation

SEQ ID NO: 429 - protein, 40 aa, Artificial Sequence; identical to SEQ ID NO: 413
  Synthetic Peptide (Compound 99)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (20)..(20): Xaa stands for Aib
  MISC_FEATURE (22)..(22): alpha-Methylation

SEQ ID NO: 430 - protein, 40 aa, Artificial Sequence; identical to SEQ ID NO: 420
  Synthetic Peptide (Compound 100)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (20)..(20): Xaa stands for Aib
  MISC_FEATURE (22)..(22): alpha-Methylation

SEQ ID NO: 431 - protein, 40 aa, Artificial Sequence; identical to SEQ ID NO: 421
  Synthetic Peptide (Compound 101)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (22)..(22): alpha-Methylation

SEQ ID NO: 432 - protein, 40 aa, Artificial Sequence; identical to SEQ ID NO: 410
  Synthetic Peptide (Compound 102)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (22)..(22): alpha-Methylation

SEQ ID NO: 433 - protein, 40 aa, Artificial Sequence
  Synthetic Peptide (Compound 103)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for D-Iva
  MISC_FEATURE (20)..(20): Xaa stands for D-Iva
YXEGTFISDYSIXLDRXAQXNFVNWLLAQRPSSGAPPPSR

SEQ ID NO: 434 - protein, 40 aa, Artificial Sequence
  Synthetic Peptide (Compound 104)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Iva
  MISC_FEATURE (20)..(20): Xaa stands for Iva
YXEGTXISDYSIALDRXAQXNFVNWLLAQRPSSGAPPPSR

SEQ ID NO: 435 - protein, 40 aa, Artificial Sequence
  Synthetic Peptide (Compound 105)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
YXEGTXISDYSIXLDRXAQQDFVNWLLAQRPSSGAPPPSR

SEQ ID NO: 436 - protein, 40 aa, Artificial Sequence; identical to SEQ ID NO: 433
  Synthetic Peptide (Compound 106)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (22)..(22): alpha-Methylation

SEQ ID NO: 437 - protein, 40 aa, Artificial Sequence; identical to SEQ ID NO: 434
  Synthetic Peptide (Compound 107)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib
  MISC_FEATURE (22)..(22): alpha-Methylation

SEQ ID NO: 438 - protein, 40 aa, Artificial Sequence
  Synthetic Peptide (Compound 108)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (20)..(20): Xaa stands for Aib
  MISC_FEATURE (22)..(22): alpha-Methylation
YXEGTXISDYSIXLDRIAQXNFVNWLLAQRPSSGAPPPSR

SEQ ID NO: 439 - protein, 40 aa, Artificial Sequence; identical to SEQ ID NO: 435
  Synthetic Peptide (Compound 109)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (22)..(22): alpha-Methylation

SEQ ID NO: 440 - protein, 40 aa, Artificial Sequence
  Synthetic Peptide (Compound 110)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
YXEGTXISDYSIXLDRXAQXNFVNWLLAQRPSSGAPPPSR

SEQ ID NO: 441 - protein, 40 aa, Artificial Sequence; identical to SEQ ID NO: 440
  Synthetic Peptide (Compound 111)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (22)..(22): alpha-Methylation

SEQ ID NO: 442 - protein, 40 aa, Artificial Sequence
  Synthetic Peptide (Compound 112)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIALDRXAQXNFVNWXLAQRPSSGAPPPSR

SEQ ID NO: 443 - protein, 40 aa, Artificial Sequence; identical to SEQ ID NO: 417
  Synthetic Peptide (Compound 113)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 444 - protein, 40 aa, Artificial Sequence; identical to SEQ ID NO: 414
  Synthetic Peptide (Compound 114)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 445 - protein, 40 aa, Artificial Sequence; identical to SEQ ID NO: 442
  Synthetic Peptide (Compound 115)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 446 - protein, 40 aa, Artificial Sequence; identical to SEQ ID NO: 417
  Synthetic Peptide (Compound 116)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 447 - protein, 40 aa, Artificial Sequence
  Synthetic Peptide (Compound 117)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIALDRXHQXNFVNWXLAQRPSSGAPPPSR

SEQ ID NO: 448 - protein, 40 aa, Artificial Sequence
  Synthetic Peptide (Compound 118)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (22)..(22): alpha-Methylation
  MISC_FEATURE (26)..(26): Xaa stands for Iva
YXEGTXISDYSIXLDRXHQQDFVNWXLAQRPSSGAPPPSR

SEQ ID NO: 449 - protein, 40 aa, Artificial Sequence
  Synthetic Peptide (Compound 119)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXLDRXHQXNFVNWXLAQRPSSGAPPPSR

SEQ ID NO: 450 - protein, 40 aa, Artificial Sequence
  Synthetic Peptide (Compound 120)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (26)..(26): Xaa stands for Iva
YXEGTXISDYSIALDRIHQQSFVNWXLAQRPSSGAPPPSR

SEQ ID NO: 451 - protein, 40 aa, Artificial Sequence; identical to SEQ ID NO: 414
  Synthetic Peptide (Compound 121)
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 452 - protein, 40 aa, Artificial Sequence; identical to SEQ ID NO: 416
  Synthetic Peptide (Compound 122)
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (22)..(22): alpha-Methylation
  MISC_FEATURE (26)..(26): Xaa stands for Iva

SEQ ID NO: 453 - protein, 40 aa, Artificial Sequence
  Synthetic Peptide (Compound 123)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (26)..(26): Xaa stands for Iva
YXEGTFISDYSIALDRIAQXDFVNWXLAQRPSSGAPPPSR

SEQ ID NO: 454 - protein, 40 aa, Artificial Sequence
  Synthetic Peptide (Compound 124)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (26)..(26): Xaa stands for Iva
YXEGTFISDYSIALDRIAQXSFVNWXLAQRPSSGAPPPSR

SEQ ID NO: 455 - protein, 40 aa, Artificial Sequence; identical to SEQ ID NO: 454
  Synthetic Peptide (Compound 125)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 456 - protein, 40 aa, Artificial Sequence
  Synthetic Peptide (Compound 126)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIALDRXAQXSFVNWXLAQRPSSGAPPPSR

SEQ ID NO: 457 - protein, 40 aa, Artificial Sequence
  Synthetic Peptide (Compound 127)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (26)..(26): Xaa stands for Iva
YXEGTXISDYSIALDRIAQQSFVNWXLAQRPSSGAPPPSR

SEQ ID NO: 458 - protein, 40 aa, Artificial Sequence
  Synthetic Peptide (Compound 128)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (26)..(26): Xaa stands for Iva
YXEGTXISDYSIALDRXAQQSFVNWXLAQRPSSGAPPPSR

SEQ ID NO: 459 - protein, 39 aa, Artificial Sequence
  Synthetic Peptide (Compound 129)
  MISC_FEATURE (1)..(1): N-terminal Methylation
  MISC_FEATURE (2)..(2): Xaa stands for Aib
YXEGTFISDYSIALDRIAQQSFVNWLLAQRPSSGAPPPS

SEQ ID NO: 460 - protein, 40 aa, Artificial Sequence; identical to SEQ ID NO: 396
  Synthetic Peptide (Compound 130)
  MISC_FEATURE (1)..(1): N-terminal Methylation
  MISC_FEATURE (2)..(2): Xaa stands for Aib
  MISC_FEATURE (26)..(26): Xaa stands for Iva

SEQ ID NO: 461 - protein, 40 aa, Artificial Sequence; identical to SEQ ID NO: 404
  Synthetic Peptide (Compound 131)
  MISC_FEATURE (1)..(1): N-terminal Methylation
  MISC_FEATURE (2)..(2): Xaa stands for Aib
  MISC_FEATURE (13)..(13): Xaa stands for D-Iva

SEQ ID NO: 462 - protein, 40 aa, Artificial Sequence; identical to SEQ ID NO: 419
  Synthetic Peptide (Compound 132)
  MISC_FEATURE (1)..(1): N-terminal Methylation
  MISC_FEATURE (2)..(2): Xaa stands for Aib
  MISC_FEATURE (6)..(6): Xaa stands for Iva

SEQ ID NO: 463 - protein, 40 aa, Artificial Sequence
  Synthetic Peptide (Compound 133)
  MISC_FEATURE (1)..(1): N-terminal Methylation
  MISC_FEATURE (2)..(2): Xaa stands for Aib
  MISC_FEATURE (26)..(26): Xaa stands for Iva
YXEGTFISDYSIALDRIAQQNFVNWXLAQRPSSGAPPPSR

SEQ ID NO: 464 - protein, 40 aa, Artificial Sequence
  Synthetic Peptide (Compound 134)
  MISC_FEATURE (1)..(1): N-terminal Methylation
  MISC_FEATURE (2)..(2): Xaa stands for Aib
  MISC_FEATURE (22)..(22): alpha-Methylation
YXEGTFISDYSIALDRIAQQNFVNWLLAQRPSSGAPPPSR

SEQ ID NO: 465 - protein, 40 aa, Artificial Sequence
  Synthetic Peptide (Compound 135)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (22)..(22): alpha-Methylation
YXEGTFISDYSIALDRIAQXDFVNWLLAQRPSSGAPPPSR

SEQ ID NO: 466 - protein, 40 aa, Artificial Sequence
  Synthetic Peptide (Compound 136)
  MISC_FEATURE (1)..(1): N-terminal Methylation
  MISC_FEATURE (2)..(2): Xaa stands for Aib
  MISC_FEATURE (20)..(20): Xaa stands for Aib
YXEGTFISDYSIALDRIAQXSFVNWLLAQRPSSGAPPPSR

SEQ ID NO: 467 - protein, 40 aa, Artificial Sequence
  Synthetic Peptide (Compound 137)
  MISC_FEATURE (1)..(1): N-terminal Methylation
  MISC_FEATURE (2)..(2): Xaa stands for Aib
  MISC_FEATURE (17)..(17): Xaa stands for Aib
YXEGTFISDYSIALDRXAQQSFVNWLLAQRPSSGAPPPSR

SEQ ID NO: 468 - protein, 40 aa, Artificial Sequence
  Synthetic Peptide (Compound 138)
  MISC_FEATURE (1)..(1): N-terminal Methylation
  MISC_FEATURE (2)..(2): Xaa stands for Aib
  MISC_FEATURE (13)..(13): Xaa stands for D-Iva
YXEGTFISDYSIXLDRIAQQSFVNWLLAQRPSSGAPPPSR

SEQ ID NO: 469 - protein, 40 aa, Artificial Sequence
  Synthetic Peptide (Compound 139)
  MISC_FEATURE (1)..(1): N-terminal Methylation
  MISC_FEATURE (2)..(2): Xaa stands for Aib
  MISC_FEATURE (6)..(6): Xaa stands for Iva
YXEGTXISDYSIALDRIAQQSFVNWLLAQRPSSGAPPPSR

SEQ ID NO: 470 - protein, 40 aa, Artificial Sequence
  Synthetic Peptide (Compound 140)
  MISC_FEATURE (1)..(1): N-terminal Methylation
  MISC_FEATURE (2)..(2): Xaa stands for Aib
  MISC_FEATURE (26)..(26): Xaa stands for Iva
YXEGTFISDYSIALDRIHQQDFVNWXLAQRPSSGAPPPSR

SEQ ID NO: 471 - protein, 40 aa, Artificial Sequence
  Synthetic Peptide (Compound 141)
  MISC_FEATURE (1)..(1): N-terminal Methylation
  MISC_FEATURE (2)..(2): Xaa stands for Aib
  MISC_FEATURE (22)..(22): alpha-Methylation
YXEGTFISDYSIALDRIHQQDFVNWLLAQRPSSGAPPPSR

SEQ ID NO: 472 - protein, 40 aa, Artificial Sequence
  Synthetic Peptide (Compound 142)
  MISC_FEATURE (1)..(1): N-terminal Methylation
  MISC_FEATURE (2)..(2): Xaa stands for Aib
  MISC_FEATURE (20)..(20): Xaa stands for Aib
YXEGTFISDYSIALDRIHQXNFVNWLLAQRPSSGAPPPSR

SEQ ID NO: 473 - protein, 40 aa, Artificial Sequence
  Synthetic Peptide (Compound 143)
  MISC_FEATURE (1)..(1): N-terminal Methylation
  MISC_FEATURE (2)..(2): Xaa stands for Aib
  MISC_FEATURE (17)..(17): Xaa stands for Aib
YXEGTFISDYSIALDRXHQQDFVNWLLAQRPSSGAPPPSR

SEQ ID NO: 474 - protein, 40 aa, Artificial Sequence
  Synthetic Peptide (Compound 144)
  MISC_FEATURE (1)..(1): N-terminal Methylation
  MISC_FEATURE (2)..(2): Xaa stands for Aib
  MISC_FEATURE (13)..(13): Xaa stands for D-Iva
YXEGTFISDYSIXLDRIHQQDFVNWLLAQRPSSGAPPPSR

SEQ ID NO: 475 - protein, 40 aa, Artificial Sequence
  Synthetic Peptide (Compound 145)
  MISC_FEATURE (1)..(1): N-terminal Methylation
  MISC_FEATURE (2)..(2): Xaa stands for Aib
  MISC_FEATURE (6)..(6): Xaa stands for Iva
YXEGTXISDYSIALDRIHQQDFVNWLLAQRPSSGAPPPSR

SEQ ID NO: 476 - protein, 40 aa, Artificial Sequence
  Synthetic Peptide (Compound 146)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva
YXEGTXISDYSIXLDRIAQXSFVNWXLAQRPSSGAPPPSR

SEQ ID NO: 477 - protein, 40 aa, Artificial Sequence
  Synthetic Peptide (Compound 147)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (20)..(20): Xaa stands for Aib
  MISC_FEATURE (26)..(26): Xaa stands for Iva
YXEGTFISDYSIXLDRIHQXNFVNWXLAQRPSSGAPPPSR

SEQ ID NO: 478 - protein, 40 aa, Artificial Sequence
  Synthetic Peptide (Compound 148)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib
YXEGTXISDYSIALDRXHQXNFVNWLLAQRPSSGAPPPSR

SEQ ID NO: 479 - protein, 40 aa, Artificial Sequence; identical to SEQ ID NO: 449
  Synthetic Peptide (Compound 149)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 480 - protein, 40 aa, Artificial Sequence; identical to SEQ ID NO: 414
  Synthetic Peptide (Compound 150)
  MISC_FEATURE (1)..(1): N-terminal Acethylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 481 - protein, 40 aa, Artificial Sequence; identical to SEQ ID NO: 420
  Synthetic Peptide (Compound 151)
  MISC_FEATURE (1)..(1): N-terminal Acethylation
  MISC_FEATURE (2)..(2): Xaa stands for Aib
  MISC_FEATURE (6)..(6): Xaa stands for Iva
  MISC_FEATURE (20)..(20): Xaa stands for Aib

SEQ ID NO: 482 - protein, 40 aa, Artificial Sequence; identical to SEQ ID NO: 422
  Synthetic Peptide (Compound 152)
  MISC_FEATURE (1)..(1): N-terminal Acethylation
  MISC_FEATURE (2)..(2): Xaa stands for Aib
  MISC_FEATURE (13)..(13): Xaa stands for D-Iva
  MISC_FEATURE (20)..(20): Xaa stands for Aib
  MISC_FEATURE (26)..(26): Xaa stands for Iva

SEQ ID NO: 483 - protein, 40 aa, Artificial Sequence; identical to SEQ ID NO: 434
  Synthetic Peptide (Compound 153)
  MISC_FEATURE (1)..(1): N-terminal Acethylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib

SEQ ID NO: 484 - protein, 40 aa, Artificial Sequence; identical to SEQ ID NO: 417
  Synthetic Peptide (Compound 154)
  MISC_FEATURE (1)..(1): N-terminal Acethylation
  MISC_FEATURE (2)..(2): Xaa stands for Aib
  MISC_FEATURE (6)..(6): Xaa stands for Iva
  MISC_FEATURE (13)..(13): Xaa stands for Iva
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 485 - protein, 40 aa, Artificial Sequence; identical to SEQ ID NO: 454
  Synthetic Peptide (Compound 155)
  MISC_FEATURE (1)..(1): N-terminal Acethylation
  MISC_FEATURE (2)..(2): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 486 - protein, 40 aa, Artificial Sequence; identical to SEQ ID NO: 447
  Synthetic Peptide (Compound 156)
  MISC_FEATURE (1)..(1): N-terminal Acethylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 487 - protein, 40 aa, Artificial Sequence; identical to SEQ ID NO: 449
  Synthetic Peptide (Compound 157)
  MISC_FEATURE (1)..(1): N-terminal Acethylation
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 488 - protein, 14 aa, Artificial Sequence
  Synthetic Peptide (PYY-1119)
  MISC_FEATURE (1)..(1): N-terminal, 4-imidazolecarbonylation
  MISC_FEATURE (2)..(2): Xaa stands for D-Hyp
  MISC_FEATURE (3)..(3): Xaa stands for Iva
  MISC_FEATURE (4)..(4): Xaa stands for Pya(4)
  MISC_FEATURE (5)..(5): Xaa stands for Cha
  MISC_FEATURE (6)..(6): Methylation
  MISC_FEATURE (9)..(9): Xaa stands for Aib
  MISC_FEATURE (14)..(14): Xaa stands for Cha
SXXXXLNKXTRQRX

SEQ ID NO: 489 - protein, 40 aa, Artificial Sequence
  Synthetic Peptide (Formula (I))
  MISC_FEATURE (2)..(2): Xaa stands for Aib or D-Ala
  MISC_FEATURE (6)..(6): Xaa stands for Iva, Phe, or Val
  MISC_FEATURE (7)..(7): Xaa stands for Ile, Lys, or Val
  MISC_FEATURE (8)..(8): Xaa stands for Ser
  MISC_FEATURE (8)..(30): any one or two amino acids selected from (8)..(30) optionally represent Lys(R), and R represents a substituent group
  MISC_FEATURE (9)..(9): Xaa stands for Asp, Leu, or Phe
  MISC_FEATURE (10)..(10): Xaa stands for Tyr
  MISC_FEATURE (11)..(11): Xaa stands for Aib or Ser
  MISC_FEATURE (12)..(12): Xaa stands for Ile
  MISC_FEATURE (13)..(13): Xaa stands for Aib, Ala, Gln, Leu, Tyr, or D-Iva
  MISC_FEATURE (14)..(14): Xaa stands for Leu
  MISC_FEATURE (15)..(15): Xaa stands for Asp, Glu, Lys, Ser, or Tyr
  MISC_FEATURE (16)..(16): Xaa stands for Arg or Lys
  MISC_FEATURE (17)..(17): Xaa stands for Aib, Gln, or Ile
  MISC_FEATURE (18)..(18): Xaa stands for Ala or His
  MISC_FEATURE (19)..(19): Xaa stands for Gln or Ser
  MISC_FEATURE (20)..(20): Xaa stands for Aib, Ala, or Gln
  MISC_FEATURE (21)..(21): Xaa stands for Asn, Asp, Glu, Leu, or Ser
  MISC_FEATURE (22)..(22): Xaa stands for Phe or  alpha-MePhe
  MISC_FEATURE (23)..(23): Xaa stands for Ile or Val
  MISC_FEATURE (24)..(24): Xaa stands for Arg, Asn, Asp, Lys, or Lys(Ac)
  MISC_FEATURE (25)..(25): Xaa stands for Trp
  MISC_FEATURE (26)..(26): Xaa stands for Aib, Iva, or Leu
  MISC_FEATURE (27)..(27): Xaa stands for Leu
  MISC_FEATURE (28)..(28): Xaa stands for Ala, Arg, Lys, or Lys(Ac)
  MISC_FEATURE (29)..(29): Xaa stands for Gln or Gly
  MISC_FEATURE (30)..(30): Xaa stands for Arg, Gly, or a deletion
  MISC_FEATURE (31)..(31): Xaa stands for Pro or a deletion
  MISC_FEATURE (31)..(40): when (31)..(40) stand for deletions, (2) stands for Aib
  MISC_FEATURE (32)..(32): Xaa stands for Ser or a deletion
  MISC_FEATURE (33)..(33): Xaa stands for Ser or a deletion
  MISC_FEATURE (34)..(34): Xaa stands for Gly or a deletion
  MISC_FEATURE (35)..(35): Xaa stands for Ala or a deletion
  MISC_FEATURE (36)..(36): Xaa stands for Pro or a deletion
  MISC_FEATURE (37)..(37): Xaa stands for Pro or a deletion
  MISC_FEATURE (38)..(38): Xaa stands for Pro or a deletion
  MISC_FEATURE (39)..(39): Xaa stands for Lys, Ser, or a deletion
  MISC_FEATURE (40)..(40): Xaa stands for  Arg, Lys, or a deletion
YXEGTXXXXXXXXXXXXXXXXXXXXXXXXXXXXXXXXXXX

SEQ ID NO: 490 - protein, 40 aa, Artificial Sequence
  Synthetic Peptide (Formula (II))
  MISC_FEATURE (2)..(2): Xaa stands for Aib or D-Ala
  MISC_FEATURE (6)..(6): Xaa stands for Iva, Phe, or Val
  MISC_FEATURE (7)..(7): Xaa stands for Ile, Lys, or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp, Leu, or Phe
  MISC_FEATURE (10)..(10): Xaa stands for Tyr
  MISC_FEATURE (11)..(11): Xaa stands for Aib or Ser
  MISC_FEATURE (12)..(12): Xaa stands for Ile
  MISC_FEATURE (13)..(13): Xaa stands for Aib, Ala, Gln, Leu, Tyr, or D-Iva
  MISC_FEATURE (14)..(14): Xaa stands for Leu
  MISC_FEATURE (15)..(15): Xaa stands for Asp, Glu, Lys, Ser, or Tyr
  MISC_FEATURE (16)..(16): Xaa stands for Arg or Lys
  MISC_FEATURE (17)..(17): Xaa stands for Aib, Gln, or Ile
  MISC_FEATURE (18)..(18): Xaa stands for Ala or His
  MISC_FEATURE (19)..(19): Xaa stands for Gln or Ser
  MISC_FEATURE (20)..(20): Xaa stands for Aib, Ala, or Gln
  MISC_FEATURE (21)..(21): Xaa stands for Asn, Asp, Glu, Leu or Ser
  MISC_FEATURE (22)..(22): Xaa stands for Phe or alpha-MePhe
  MISC_FEATURE (23)..(23): Xaa stands for Ile or Val
  MISC_FEATURE (24)..(24): Xaa stands for Arg, Asn, Asp,  Lys, or Lys(Ac)
  MISC_FEATURE (25)..(25): Xaa stands for Trp
  MISC_FEATURE (26)..(26): Xaa stands for Aib, Iva, or Leu
  MISC_FEATURE (27)..(27): Xaa stands for Leu
  MISC_FEATURE (28)..(28): Xaa stands for Ala, Arg, Lys, or Lys(Ac)
  MISC_FEATURE (29)..(29): Xaa stands for Gln or Gly
  MISC_FEATURE (30)..(30): Xaa stands for Arg or Gly
  MISC_FEATURE (39)..(39): Xaa stands for Lys or Ser
  MISC_FEATURE (40)..(40): Xaa stands for Arg, Lys, or a deletion
YXEGTXXXXXXXXXXXXXXXXXXXXXXXXXPSSGAPPPXX

SEQ ID NO: 491 - protein, 40 aa, Artificial Sequence
  Synthetic Peptide (Formula (III))
  MISC_FEATURE (2)..(2): Xaa stands for Aib or D-Ala
  MISC_FEATURE (7)..(7): Xaa stands for Ile, Lys, or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp, Leu, or Phe
  MISC_FEATURE (10)..(10): Xaa stands for Tyr
  MISC_FEATURE (11)..(11): Xaa stands for Ser
  MISC_FEATURE (12)..(12): Xaa stands for Ile
  MISC_FEATURE (13)..(13): Xaa stands for Aib, Ala, Gln, Leu, or Tyr
  MISC_FEATURE (14)..(14): Xaa stands for Leu
  MISC_FEATURE (15)..(15): Xaa stands for Asp, Glu, Lys, Ser, or Tyr
  MISC_FEATURE (16)..(16): Xaa stands for Lys
  MISC_FEATURE (17)..(17): Xaa stands for Gln, or Ile
  MISC_FEATURE (18)..(18): Xaa stands for Ala or His
  MISC_FEATURE (19)..(19): Xaa stands for Gln or Ser
  MISC_FEATURE (20)..(20): Xaa stands for Aib, or Gln
  MISC_FEATURE (21)..(21): Xaa stands for Glu, or Leu
  MISC_FEATURE (22)..(22): Xaa stands for Phe
  MISC_FEATURE (23)..(23): Xaa stands for Ile or Val
  MISC_FEATURE (24)..(24): Xaa stands for Lys, or Lys(Ac)
  MISC_FEATURE (25)..(25): Xaa stands for Trp
  MISC_FEATURE (26)..(26): Xaa stands for Aib, or Leu
  MISC_FEATURE (27)..(27): Xaa stands for Leu
  MISC_FEATURE (28)..(28): Xaa stands for Lys, or Lys(Ac)
  MISC_FEATURE (29)..(29): Xaa stands for Gly
  MISC_FEATURE (30)..(30): Xaa stands for Gly
  MISC_FEATURE (39)..(39): Xaa stands for Lys, or Ser
  MISC_FEATURE (40)..(40): Xaa stands for Lys, or a deletion
YXEGTVXXXXXXXXXXXXXXXXXXXXXXXXPSSGAPPPXX

SEQ ID NO: 492 - protein, 40 aa, Artificial Sequence
  Synthetic Peptide (Formula (IV))
  MISC_FEATURE (2)..(2): Xaa stands for Aib
  MISC_FEATURE (6)..(6): Xaa stands for Iva, Phe, or Val
  MISC_FEATURE (7)..(7): Xaa stands for Ile, or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp or Leu
  MISC_FEATURE (10)..(10): Xaa stands for Tyr
  MISC_FEATURE (11)..(11): Xaa stands for Aib or Ser
  MISC_FEATURE (12)..(12): Xaa stands for Ile
  MISC_FEATURE (13)..(13): Xaa stands for Aib, Ala, or D-Iva
  MISC_FEATURE (14)..(14): Xaa stands for Leu
  MISC_FEATURE (15)..(15): Xaa stands for Asp
  MISC_FEATURE (16)..(16): Xaa stands for Arg
  MISC_FEATURE (17)..(17): Xaa stands for Aib, Gln, or Ile
  MISC_FEATURE (18)..(18): Xaa stands for Ala or His
  MISC_FEATURE (19)..(19): Xaa stands for Gln
  MISC_FEATURE (20)..(20): Xaa stands for Aib, Ala, or Gln
  MISC_FEATURE (21)..(21): Xaa stands for Glu, Asn, Asp, or Ser
  MISC_FEATURE (22)..(22): Xaa stands for Phe or alpha-MePhe
  MISC_FEATURE (23)..(23): Xaa stands for Val
  MISC_FEATURE (24)..(24): Xaa stands for Arg, Asp, or Asn
  MISC_FEATURE (25)..(25): Xaa stands for Trp
  MISC_FEATURE (26)..(26): Xaa stands for Leu or Iva
  MISC_FEATURE (27)..(27): Xaa stands for Leu
  MISC_FEATURE (28)..(28): Xaa stands for Ala or Arg
  MISC_FEATURE (29)..(29): Xaa stands for Gln or Gly
  MISC_FEATURE (30)..(30): Xaa stands for Arg or Gly
  MISC_FEATURE (40)..(40): Xaa stands for Arg or a deletion
YXEGTXXXXXXXXXXXXXXXXXXXXXXXXXPSSGAPPPSX

SEQ ID NO: 493 - protein, 40 aa, Artificial Sequence; identical to SEQ ID NO: 489
  Synthetic Peptide (Formula (V))
  MISC_FEATURE (2)..(2): Xaa stands for Aib
  MISC_FEATURE (6)..(6): Xaa stands for Iva, Phe, or Val
  MISC_FEATURE (7)..(7): Xaa stands for Ile, Lys, or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp, Leu, or Phe
  MISC_FEATURE (10)..(10): Xaa stands for Tyr
  MISC_FEATURE (11)..(11): Xaa stands for Aib or Ser
  MISC_FEATURE (12)..(12): Xaa stands for Ile
  MISC_FEATURE (13)..(13): Xaa stands for Aib, Ala, Gln, Leu, Tyr, or D-Iva
  MISC_FEATURE (14)..(14): Xaa stands for Leu
  MISC_FEATURE (15)..(15): Xaa stands for Asp, Glu, Lys, Ser, or Tyr
  MISC_FEATURE (16)..(16): Xaa stands for Arg or Lys
  MISC_FEATURE (17)..(17): Xaa stands for Aib, Gln, or Ile
  MISC_FEATURE (18)..(18): Xaa stands for Ala or His
  MISC_FEATURE (19)..(19): Xaa stands for Gln or Ser
  MISC_FEATURE (21)..(21): Xaa stands for  Asn, Asp, Glu, Leu, or Ser
  MISC_FEATURE (22)..(22): Xaa stands for Phe or alpha-MePhe
  MISC_FEATURE (23)..(23): Xaa stands for Ile or Val
  MISC_FEATURE (24)..(24): Xaa stands for Arg, Asn, Lys, or Lys(Ac)
  MISC_FEATURE (25)..(25): Xaa stands for Trp
  MISC_FEATURE (26)..(26): Xaa stands for Aib, Iva, or Leu
  MISC_FEATURE (27)..(27): Xaa stands for Leu
  MISC_FEATURE (28)..(28): Xaa stands for Ala, Arg, Lys, or Lys(Ac)
  MISC_FEATURE (29)..(29): Xaa stands for Gln or Gly
  MISC_FEATURE (30)..(30): Xaa stands for Arg, Gly or a deletion
  MISC_FEATURE (31)..(40): Xaa stands for a deletion

SEQ ID NO: 494 - protein, 40 aa, Artificial Sequence; identical to SEQ ID NO: 492
  Synthetic Peptide (Formula (VI))
  MISC_FEATURE (2)..(2): Xaa stands for Aib
  MISC_FEATURE (6)..(6): Xaa stands for Iva, Phe, or Val
  MISC_FEATURE (7)..(7): Xaa stands for Ile or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp or Leu
  MISC_FEATURE (10)..(10): Xaa stands for Tyr
  MISC_FEATURE (11)..(11): Xaa stands for Ser
  MISC_FEATURE (12)..(12): Xaa stands for Ile
  MISC_FEATURE (13)..(13): Xaa stands for Aib or Ala
  MISC_FEATURE (14)..(14): Xaa stands for Leu
  MISC_FEATURE (15)..(15): Xaa stands for Asp
  MISC_FEATURE (16)..(16): Xaa stands for Arg or Lys
  MISC_FEATURE (17)..(17): Xaa stands for Aib, Gln or Ile
  MISC_FEATURE (18)..(18): Xaa stands for Ala or His
  MISC_FEATURE (19)..(19): Xaa stands for Gln
  MISC_FEATURE (20)..(20): Xaa stands for Aib or Gln
  MISC_FEATURE (21)..(21): Xaa stands for Asn, Glu, or Asp
  MISC_FEATURE (22)..(22): Xaa stands for Phe
  MISC_FEATURE (23)..(23): Xaa stands for Val
  MISC_FEATURE (24)..(24): Xaa stands for Arg, Asn, or Lys
  MISC_FEATURE (25)..(25): Xaa stands for Trp
  MISC_FEATURE (26)..(26): Xaa stands for Iva or Leu
  MISC_FEATURE (27)..(27): Xaa stands for Leu
  MISC_FEATURE (28)..(28): Xaa stands for Ala, Arg, or Lys
  MISC_FEATURE (29)..(29): Xaa stands for Gln or Gly
  MISC_FEATURE (30)..(30): Xaa stands for Arg, or Gly
  MISC_FEATURE (40)..(40): Xaa stands for Arg, Lys, or a deletion

SEQ ID NO: 495 - protein, 30 aa, Artificial Sequence
  Synthetic Peptide
  MISC_FEATURE (2)..(2): Xaa stands for Aib
  MISC_FEATURE (12)..(12): Xaa stands for K(PEG(2)-Pal)
  MISC_FEATURE (13)..(13): Xaa stands for Aib
  MISC_FEATURE (20)..(20): Xaa stands for Aib
  MISC_FEATURE (20)..(20): Xaa stands for Aib
YXEGTVVSLYSXXLDKQAQXEFVKWLLAQK

SEQ ID NO: 496 - protein, 30 aa, Artificial Sequence; identical to SEQ ID NO: 495
  Synthetic Peptide
  MISC_FEATURE (2)..(2): Xaa stands for Aib
  MISC_FEATURE (12)..(12): Xaa stands for K(Pal)
  MISC_FEATURE (13)..(13): Xaa stands for Aib
  MISC_FEATURE (20)..(20): Xaa stands for Aib

SEQ ID NO: 497 - protein, 31 aa, Artificial Sequence; identical to SEQ ID NO: 31
  Synthetic Peptide
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (31)..(31): Xaa stands for K(PEG(2)-Pal)

SEQ ID NO: 498 - protein, 31 aa, Artificial Sequence; identical to SEQ ID NO: 31
  Synthetic Peptide
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (31)..(31): Xaa stands for K(Pal)

SEQ ID NO: 499 - protein, 30 aa, Artificial Sequence
  Synthetic Peptide
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (30)..(30): Xaa stands for K(PEG(2)-Pal)
YXEGTVVSLYSIXLDKQAQXEFVKWLLKGX

SEQ ID NO: 500 - protein, 30 aa, Artificial Sequence; identical to SEQ ID NO: 499
  Synthetic Peptide
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (30)..(30): Xaa stands for K(Pal)

SEQ ID NO: 501 - protein, 39 aa, Artificial Sequence
  Synthetic Peptide
  MISC_FEATURE (2)..(2): Xaa stands for Aib
  MISC_FEATURE (12)..(12): Xaa stands for K(Pal)
  MISC_FEATURE (13)..(13): Xaa stands for Aib
  MISC_FEATURE (20)..(20): Xaa stands for Aib
YXEGTVVSLYSXXLDRQAQXEFVRWLLRGGPSSGAPPPS

SEQ ID NO: 502 - protein, 39 aa, Artificial Sequence; identical to SEQ ID NO: 501
  Synthetic Peptide
  MISC_FEATURE (2)..(2): Xaa stands for Aib
  MISC_FEATURE (12)..(12): Xaa stands for K(Eda)
  MISC_FEATURE (13)..(13): Xaa stands for Aib
  MISC_FEATURE (20)..(20): Xaa stands for Aib

SEQ ID NO: 503 - protein, 39 aa, Artificial Sequence; identical to SEQ ID NO: 501
  Synthetic Peptide
  MISC_FEATURE (2)..(2): Xaa stands for Aib
  MISC_FEATURE (12)..(12): Xaa stands for K(GGGG-Pal)
  MISC_FEATURE (13)..(13): Xaa stands for Aib
  MISC_FEATURE (20)..(20): Xaa stands for Aib

SEQ ID NO: 504 - protein, 39 aa, Artificial Sequence; identical to SEQ ID NO: 501
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib

SEQ ID NO: 505 - protein, 39 aa, Artificial Sequence
  Synthetic Peptide
  MISC_FEATURE (2)..(2): Xaa stands for Aib
  MISC_FEATURE (12)..(12): Xaa stands for K(Pal)
  MISC_FEATURE (13)..(13): Xaa stands for Aib
  MISC_FEATURE (20)..(20): Xaa stands for Aib
  MISC_FEATURE (24)..(24): Xaa stands for K(Ac)
YXEGTVVSLYSXXLDRQAQXEFVXWLLRGGPSSGAPPPS

SEQ ID NO: 506 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for K(Eda)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 507 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for K(GGGG-Pal)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 508 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 509 - protein, 39 aa, Artificial Sequence
  Synthetic Peptide
  MISC_FEATURE (2)..(2): Xaa stands for Aib
  MISC_FEATURE (12)..(12): Xaa stands for K(PEG(2)-Pal)
YXEGTFISDYSXALDRIHQQDFVNWLLAQRPSSGAPPPS

SEQ ID NO: 510 - protein, 39 aa, Artificial Sequence; identical to SEQ ID NO: 509
  Synthetic Peptide
  MISC_FEATURE (2)..(2): Xaa stands for Aib
  MISC_FEATURE (12)..(12): Xaa stands for K(PEG(2)-Ac)

SEQ ID NO: 511 - protein, 39 aa, Artificial Sequence; identical to SEQ ID NO: 509
  Synthetic Peptide
  MISC_FEATURE (2)..(2): Xaa stands for Aib
  MISC_FEATURE (12)..(12): Xaa stands for K(PEG(2)-hexanoyl)

SEQ ID NO: 512 - protein, 39 aa, Artificial Sequence; identical to SEQ ID NO: 509
  Synthetic Peptide
  MISC_FEATURE (2)..(2): Xaa stands for Aib
  MISC_FEATURE (12)..(12): Xaa stands for K(PEG(2)-dodecanoyl)

SEQ ID NO: 513 - protein, 39 aa, Artificial Sequence; identical to SEQ ID NO: 509
  Synthetic Peptide
  MISC_FEATURE (2)..(2): Xaa stands for Aib
  MISC_FEATURE (12)..(12): Xaa stands for K(PEG(2)-octadecanoyl)

SEQ ID NO: 514 - protein, 40 aa, Artificial Sequence
  Synthetic Peptide
  MISC_FEATURE (2)..(2): Xaa stands for Aib
  MISC_FEATURE (12)..(12): Xaa stands for K(PEG(2)-Pal)
YXEGTFISDYSXALDRIHQQDFVNWLLAQRPSSGAPPPSR

SEQ ID NO: 515 - protein, 40 aa, Artificial Sequence; identical to SEQ ID NO: 514
  Synthetic Peptide
  MISC_FEATURE (2)..(2): Xaa stands for Aib
  MISC_FEATURE (12)..(12): Xaa stands for K(PEG(2)-Ac)

SEQ ID NO: 516 - protein, 40 aa, Artificial Sequence; identical to SEQ ID NO: 514
  Synthetic Peptide
  MISC_FEATURE (2)..(2): Xaa stands for Aib
  MISC_FEATURE (12)..(12): Xaa stands for K(PEG(2)-hexanoyl)

SEQ ID NO: 517 - protein, 40 aa, Artificial Sequence; identical to SEQ ID NO: 514
  Synthetic Peptide
  MISC_FEATURE (2)..(2): Xaa stands for Aib
  MISC_FEATURE (12)..(12): Xaa stands for K(PEG(2)-dodecanoyl)

SEQ ID NO: 518 - protein, 40 aa, Artificial Sequence; identical to SEQ ID NO: 514
  Synthetic Peptide
  MISC_FEATURE (2)..(2): Xaa stands for Aib
  MISC_FEATURE (12)..(12): Xaa stands for K(PEG(2)-octadecanoyl)

SEQ ID NO: 519 - protein, 40 aa, Artificial Sequence
  Synthetic Peptide
  MISC_FEATURE (2)..(2): Xaa stands for Aib
  MISC_FEATURE (12)..(12): Xaa stands for K(PEG(2)-decanoyl)
YXEGTFISDYSXALDRIAQQDFVNWLLAQRPSSGAPPPSR

SEQ ID NO: 520 - protein, 40 aa, Artificial Sequence; identical to SEQ ID NO: 519
  Synthetic Peptide
  MISC_FEATURE (2)..(2): Xaa stands for Aib
  MISC_FEATURE (12)..(12): Xaa stands for K(PEG(2)-undecanoyl)

SEQ ID NO: 521 - protein, 40 aa, Artificial Sequence; identical to SEQ ID NO: 519
  Synthetic Peptide
  MISC_FEATURE (2)..(2): Xaa stands for Aib
  MISC_FEATURE (12)..(12): Xaa stands for K(PEG(2)-dodecanoyl)

SEQ ID NO: 522 - protein, 40 aa, Artificial Sequence; identical to SEQ ID NO: 519
  Synthetic Peptide
  MISC_FEATURE (2)..(2): Xaa stands for Aib
  MISC_FEATURE (12)..(12): Xaa stands for K(PEG(2)-tridecanoyl)

SEQ ID NO: 523 - protein, 40 aa, Artificial Sequence; identical to SEQ ID NO: 519
  Synthetic Peptide
  MISC_FEATURE (2)..(2): Xaa stands for Aib
  MISC_FEATURE (12)..(12): Xaa stands for K(PEG(2)-tetradecanoyl)

SEQ ID NO: 524 - protein, 40 aa, Artificial Sequence; identical to SEQ ID NO: 519
  Synthetic Peptide
  MISC_FEATURE (2)..(2): Xaa stands for Aib
  MISC_FEATURE (12)..(12): Xaa stands for K(PEG(2)-pentadecanoyl)

SEQ ID NO: 525 - protein, 40 aa, Artificial Sequence; identical to SEQ ID NO: 519
  Synthetic Peptide
  MISC_FEATURE (2)..(2): Xaa stands for Aib
  MISC_FEATURE (12)..(12): Xaa stands for K(PEG(2)-Dda)

SEQ ID NO: 526 - protein, 40 aa, Artificial Sequence; identical to SEQ ID NO: 519
  Synthetic Peptide
  MISC_FEATURE (2)..(2): Xaa stands for Aib
  MISC_FEATURE (12)..(12): Xaa stands for K(PEG(4)-dodecanoyl)

SEQ ID NO: 527 - protein, 40 aa, Artificial Sequence; identical to SEQ ID NO: 519
  Synthetic Peptide
  MISC_FEATURE (2)..(2): Xaa stands for Aib
  MISC_FEATURE (12)..(12): Xaa stands for K(PEG(4)-Pal)

SEQ ID NO: 528 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
YXEGTFISDYSXALDRIAQQDFVNWLLAQRPSSGAPPPS

SEQ ID NO: 529 - protein, 39 aa, Artificial Sequence; identical to SEQ ID NO: 528
  Synthetic Peptide
  MISC_FEATURE (2)..(2): Xaa stands for Aib
  MISC_FEATURE (12)..(12): Xaa stands for Lys(Dodecanoyl-PEG(2)-)

SEQ ID NO: 530 - protein, 40 aa, Artificial Sequence
  Synthetic peptide
  MISC_FEATURE (2)..(2): Xaa stands for Aib
  MISC_FEATURE (12)..(12): Xaa stands for Lys(Dodecanoyl-PEG(2)-)
  MISC_FEATURE (26)..(26): Xaa stands for Iva
YXEGTFISDYSXALDRIAQQDFVNWXLAQRPSSGAPPPSR

SEQ ID NO: 531 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (25)..(25): Xaa stands for alpha-MeF
YXEGTFISDYSXALDRIAQQDFVNXLLAQRPSSGAPPPSR

SEQ ID NO: 532 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
YXEGTFISDYSXALDRIAQQDXVNWLLAQRPSSGAPPPSR

SEQ ID NO: 533 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
YXEGTFISDYSXALDRIAQQSFVNWLLAQRPSSGAPPPSR

SEQ ID NO: 534 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
YXEGTFISDYSXALDRIAQXNFVNWLLAQRPSSGAPPPSR

SEQ ID NO: 535 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
YXEGTFISDYSXALDRXAQQDFVNWLLAQRPSSGAPPPSR

SEQ ID NO: 536 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (13)..(13): Xaa stands for DIva
YXEGTFISDYSXXLDRIAQQDFVNWLLAQRPSSGAPPPSR

SEQ ID NO: 537 - protein, 40 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
YXEGTXISDYSXALDRIAQQDFVNWLLAQRPSSGAPPPSR

SEQ ID NO: 538 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (26)..(26): Xaa stands for Iva
YXEGTFISDYSXALDRIAQQDFVNWXLAQRPSSGAPPPS

SEQ ID NO: 539 - protein, 39 aa, Artificial Sequence
  Synthetic peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
YXEGTFISDYSXALDRIAQQDXVNWLLAQRPSSGAPPPS

SEQ ID NO: 540 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
YXEGTFISDYSXALDRIAQQSFVNWLLAQRPSSGAPPPS

SEQ ID NO: 541 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
YXEGTFISDYSXALDRIAQXNFVNWLLAQRPSSGAPPPS

SEQ ID NO: 542 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
YXEGTFISDYSXALDRXAQQDFVNWLLAQRPSSGAPPPS

SEQ ID NO: 543 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (13)..(13): Xaa stands for DIva
YXEGTFISDYSXXLDRIAQQDFVNWLLAQRPSSGAPPPS

SEQ ID NO: 544 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
YXEGTXISDYSXALDRIAQQDFVNWLLAQRPSSGAPPPS

SEQ ID NO: 545 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
YXEGTFISDYSXALDRIHQQDXVNWLLAQRPSSGAPPPS

SEQ ID NO: 546 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
YXEGTFISDYSXALDRIHQXNFVNWLLAQRPSSGAPPPS

SEQ ID NO: 547 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
YXEGTFISDYSXALDRXHQQDFVNWLLAQRPSSGAPPPS

SEQ ID NO: 548 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSXALDRXAQXNFVNWXLAQRPSSGAPPPS

SEQ ID NO: 549 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
  MISC_FEATURE (22)..(22): Xaa stands for alpha-MeF
  misc_feature (26)..(26): Xaa can be any naturally occurring amino acid
YXEGTFISDYSXALDRIAQXNXVNWXLAQRPSSGAPPPS

SEQ ID NO: 550 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (22)..(22): Xaa stands for alpha-MeF
YXEGTFISDYSXALDRXAQQDXVNWLLAQRPSSGAPPPS

SEQ ID NO: 551 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
YXEGTXISDYSXALDRXAQXNFVNWLLAQRPSSGAPPPS

SEQ ID NO: 552 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSXALDRXHQXNFVNWXLAQRPSSGAPPPS

SEQ ID NO: 553 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
  MISC_FEATURE (22)..(22): Xaa stands for alpha-MeF
  MISC_FEATURE (26)..(26): Xaa stands for Iva
YXEGTFISDYSXALDRIHQXNXVNWXLAQRPSSGAPPPS

SEQ ID NO: 554 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (22)..(22): Xaa stands for alpha-MeF
YXEGTFISDYSXALDRXHQQDXVNWLLAQRPSSGAPPPS

SEQ ID NO: 555 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
YXEGTXISDYSXALDRXHQXNFVNWLLAQRPSSGAPPPS

SEQ ID NO: 556 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXALDRXHQXNFVNWXLAQRPSSGAPPPS

SEQ ID NO: 557 - protein, 39 aa, Artificial Sequence
  Synthetic peptide
  MISC_FEATURE (2)..(2): Xaa stands for Aib
  MISC_FEATURE (12)..(12): Xaa stands for Lys(Dodecanoyl-PEG(2)-)
  MISC_FEATURE (26)..(26): Xaa stands for Iva
YXEGTFISDYSXALDRIAQQSFVNWXLAQRPSSGAPPPS

SEQ ID NO: 558 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
  MISC_FEATURE (26)..(26): Xaa stands for Iva
YXEGTFISDYSXALDRIAQQSXVNWXLAQRPSSGAPPPS

SEQ ID NO: 559 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (26)..(26): Xaa stands for Iva
YXEGTFISDYSXALDRIHQQSFVNWXLAQRPSSGAPPPS

SEQ ID NO: 560 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
  MISC_FEATURE (26)..(26): Xaa stands for Iva
YXEGTFISDYSXALDRIHQQSXVNWXLAQRPSSGAPPPS

SEQ ID NO: 561 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (26)..(26): Xaa stands for Iva
YXEGTFISDYSXALDRXHQQSFVNWXLAQRPSSGAPPPS

SEQ ID NO: 562 - protein, 39 aa, Artificial Sequence; identical to SEQ ID NO: 509
  Synthetic Peptide
  MISC_FEATURE (2)..(2): Xaa stands for Aib
  MISC_FEATURE (12)..(12): Xaa stands for C(1S2S-11NC-acetyl)

SEQ ID NO: 563 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(PEG(2)-dodec)
  MISC_FEATURE (20)..(20): Xaa stands for Aib
  MISC_FEATURE (26)..(26): Xaa stands for Iva
YXEGTXISDYSIXLDRXAQXNFVNWXLAQRPSSGAPPPS

SEQ ID NO: 564 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(PEG(2)-Pal)
  MISC_FEATURE (20)..(20): Xaa stands for Aib
  MISC_FEATURE (26)..(26): Xaa stands for Iva

SEQ ID NO: 565 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-) .
  MISC_FEATURE (20)..(20): Xaa stands for Aib
  MISC_FEATURE (26)..(26): Xaa stands for Iva

SEQ ID NO: 566 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for K(PEG(2)-dodec)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVNWXLAQRPSSGAPPPS

SEQ ID NO: 567 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for K(PEG(2)-Pal)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 568 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 569 - protein, 39 aa, Artificial Sequence
  Synthetic Peptide
  MISC_FEATURE (2)..(2): Xaa stands for Aib
  MISC_FEATURE (17)..(17): Xaa stands for K(PEG(2)-dodec)
YXEGTFISDYSIALDRXHQQDFVNWLLAQRPSSGAPPPS

SEQ ID NO: 570 - protein, 39 aa, Artificial Sequence; identical to SEQ ID NO: 569
  Synthetic Peptide
  MISC_FEATURE (2)..(2): Xaa stands for Aib
  MISC_FEATURE (17)..(17): Xaa stands for K(PEG(2)-Pal)

SEQ ID NO: 571 - protein, 39 aa, Artificial Sequence; identical to SEQ ID NO: 569
  Synthetic Peptide
  MISC_FEATURE (2)..(2): Xaa stands for Aib
  MISC_FEATURE (17)..(17): Xaa stands for Lys(Eda-PEG(2)-) .

SEQ ID NO: 572 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-PEG3-PEG3-isoGlu-Eda)
  MISC_FEATURE (20)..(20): Xaa stands for Aib
  MISC_FEATURE (26)..(26): Xaa stands for Iva

SEQ ID NO: 573 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for K(-PEG3-PEG3-isoGlu-Eda)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 574 - protein, 39 aa, Artificial Sequence; identical to SEQ ID NO: 569
  Synthetic Peptide
  MISC_FEATURE (2)..(2): Xaa stands for Aib
  MISC_FEATURE (17)..(17): Xaa stands for K(-PEG3-PEG3-isoGlu-Eda)

SEQ ID NO: 575 - protein, 39 aa, Artificial Sequence; identical to SEQ ID NO: 509
  Synthetic Peptide
  MISC_FEATURE (2)..(2): Xaa stands for Aib
  MISC_FEATURE (12)..(12): Xaa stands for K(-PEG3-PEG3-isoGlu-Eda)

SEQ ID NO: 576 - protein, 39 aa, Artificial Sequence
  Synthetic Peptide
  MISC_FEATURE (2)..(2): Xaa stands for Aib
  MISC_FEATURE (17)..(17): Xaa stands for K(PEG(2)-dodec)
  MISC_FEATURE (20)..(20): Xaa stands for Aib
  MISC_FEATURE (26)..(26): Xaa stands for Iva
YXEGTFISDYSIALDRXHQXNFVNWXLAQRPSSGAPPPS

SEQ ID NO: 577 - protein, 39 aa, Artificial Sequence; identical to SEQ ID NO: 576
  Synthetic Peptide
  MISC_FEATURE (2)..(2): Xaa stands for Aib
  MISC_FEATURE (17)..(17): Xaa stands for K(PEG(2)-Pal)
  MISC_FEATURE (20)..(20): Xaa stands for Aib
  MISC_FEATURE (26)..(26): Xaa stands for Iva

SEQ ID NO: 578 - protein, 39 aa, Artificial Sequence; identical to SEQ ID NO: 576
  Synthetic Peptide
  MISC_FEATURE (2)..(2): Xaa stands for Aib
  MISC_FEATURE (17)..(17): Xaa stands for Lys(Eda-PEG(2)-) .
  misc_feature (20)..(20): Xaa can be any naturally occurring amino acid
  MISC_FEATURE (26)..(26): Xaa stands for Iva

SEQ ID NO: 579 - protein, 39 aa, Artificial Sequence; identical to SEQ ID NO: 552
  Synthetic Peptide
  MISC_FEATURE (2)..(2): Xaa stands for Aib
  MISC_FEATURE (12)..(12): Xaa stands for K(-PEG3-PEG3-isoGlu-Eda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 580 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Ac--) .
  MISC_FEATURE (20)..(20): Xaa stands for Aib
  MISC_FEATURE (26)..(26): Xaa stands for Iva
YXEGTXISDYSIXLDRXHQXNFVNWXLAQRPSSGAPPPS

SEQ ID NO: 581 - protein, 39 aa, Artificial Sequence; identical to SEQ ID NO: 501
  Synthetic Peptide
  MISC_FEATURE (2)..(2): Xaa stands for Aib
  MISC_FEATURE (12)..(12): Xaa stands for Lys(Eda-PEG(2)-)
  MISC_FEATURE (13)..(13): Xaa stands for Aib
  MISC_FEATURE (20)..(20): Xaa stands for Aib

SEQ ID NO: 582 - protein, 39 aa, Artificial Sequence; identical to SEQ ID NO: 501
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib

SEQ ID NO: 583 - protein, 39 aa, Artificial Sequence; identical to SEQ ID NO: 501
  Synthetic Peptide
  MISC_FEATURE (2)..(2): Xaa stands for Aib
  MISC_FEATURE (12)..(12): Xaa stands for Lys(Eicosanoyl-GGGG-)
  MISC_FEATURE (13)..(13): Xaa stands for Aib
  MISC_FEATURE (20)..(20): Xaa stands for Aib

SEQ ID NO: 584 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for Lys(Eda-PEG(2)-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 585 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 586 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for Lys(Eicosanoyl-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 587 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 588 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eicosanoyl-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 589 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 590 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGG-)
  MISC_FEATURE (20)..(20): Xaa stands for Aib
  MISC_FEATURE (26)..(26): Xaa stands for Iva

SEQ ID NO: 591 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eicosanoyl-PEG(2)-) .
  MISC_FEATURE (20)..(20): Xaa stands for Aib
  MISC_FEATURE (26)..(26): Xaa stands for Iva

SEQ ID NO: 592 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-) .
  MISC_FEATURE (20)..(20): Xaa stands for Aib
  MISC_FEATURE (26)..(26): Xaa stands for Iva

SEQ ID NO: 593 - protein, 30 aa, Artificial Sequence
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
YXEGTVVSLYSXXLDRQAQXEFVRWLLAQR

SEQ ID NO: 594 - protein, 30 aa, Artificial Sequence; identical to SEQ ID NO: 593
  Synthetic Peptide
  MISC_FEATURE (2)..(2): Xaa stands for Aib
  MISC_FEATURE (12)..(12): Xaa stands for Lys(Octadecanoyl-GGGG-)
  MISC_FEATURE (13)..(13): Xaa stands for Aib
  MISC_FEATURE (20)..(20): Xaa stands for Aib

SEQ ID NO: 595 - protein, 30 aa, Artificial Sequence; identical to SEQ ID NO: 593
  Synthetic Peptide
  MISC_FEATURE (2)..(2): Xaa stands for Aib
  MISC_FEATURE (12)..(12): Xaa stands for Lys(Octadecanoyl-GGGG-)
  MISC_FEATURE (13)..(13): Xaa stands for Aib
  MISC_FEATURE (20)..(20): Xaa stands for Aib

SEQ ID NO: 596 - protein, 30 aa, Artificial Sequence
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)
YXEGTVVSLYSXXLDRQAQXEFVXWLLAQR

SEQ ID NO: 597 - protein, 30 aa, Artificial Sequence; identical to SEQ ID NO: 596
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 598 - protein, 30 aa, Artificial Sequence; identical to SEQ ID NO: 596
  Synthetic Peptide
  MISC_FEATURE (2)..(2): Xaa stands for Aib
  MISC_FEATURE (12)..(12): Xaa stands for Lys(Octadecanoyl-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 599 - protein, 30 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVNWXLAQR

SEQ ID NO: 600 - protein, 30 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXHQXNFVNWXLAQR

SEQ ID NO: 601 - protein, 30 aa, Artificial Sequence; identical to SEQ ID NO: 599
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 602 - protein, 30 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Lys(Eda-PEG(2)-) .
  MISC_FEATURE (20)..(20): Xaa stands for Aib
  MISC_FEATURE (26)..(26): Xaa stands for Iva
YXEGTXISDYSIXLDRXAQXNFVNWXLAQR

SEQ ID NO: 603 - protein, 30 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva
YXEGTXISDYSIXLDRXHQXNFVNWXLAQR

SEQ ID NO: 604 - protein, 40 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVNWXLAQRPSSGAPPPSE

SEQ ID NO: 605 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVDWXLAQRPSSGAPPPS

SEQ ID NO: 606 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVEWXLAQRPSSGAPPPS

SEQ ID NO: 607 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAEXNFVNWXLAQRPSSGAPPPS

SEQ ID NO: 608 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXELDRXAQXNFVNWXLAQRPSSGAPPPS

SEQ ID NO: 609 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYEXXLDRXAQXNFVNWXLAQRPSSGAPPPS

SEQ ID NO: 610 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGEXISDYSXXLDRXAQXNFVNWXLAQRPSSGAPPPS

SEQ ID NO: 611 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva
YXEGTXISDYSEXLDRXAQXNFVNWXLAQRPSSGAPPPS

SEQ ID NO: 612 - protein, 40 aa, Artificial Sequence; identical to SEQ ID NO: 604
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda- - -)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 613 - protein, 40 aa, Artificial Sequence; identical to SEQ ID NO: 604
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 614 - protein, 40 aa, Artificial Sequence; identical to SEQ ID NO: 604
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 615 - protein, 40 aa, Artificial Sequence; identical to SEQ ID NO: 604
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 616 - protein, 40 aa, Artificial Sequence; identical to SEQ ID NO: 604
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)4-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 617 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda- - -)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 618 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-G-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 619 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 620 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 621 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 622 - protein, 39 aa, Artificial Sequence
  Synthetic Peptide
  MISC_FEATURE (2)..(2): Xaa stands for Aib
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (24)..(24): Xaa stands for K(Ac)
YXEGTVVSLYSIXLDRXAQXEFVXWLLRGGPSSGAPPPS

SEQ ID NO: 623 - protein, 39 aa, Artificial Sequence; identical to SEQ ID NO: 622
  Synthetic Peptide
  MISC_FEATURE (2)..(2): Xaa stands for Aib
  MISC_FEATURE (13)..(13): Xaa stands for Aib
  MISC_FEATURE (17)..(17): Xaa stands for Lys(Eda-GGGG-)
  MISC_FEATURE (20)..(20): Xaa stands for Aib
  MISC_FEATURE (24)..(24): Xaa stands for K(Ac)

SEQ ID NO: 624 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (8)..(8): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXIXDYSIXLDRXAQXNFVNWXLAQRPSSGAPPPS

SEQ ID NO: 625 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (9)..(9): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISXYSIXLDRXAQXNFVNWXLAQRPSSGAPPPS

SEQ ID NO: 626 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (10)..(10): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDXSIXLDRXAQXNFVNWXLAQRPSSGAPPPS

SEQ ID NO: 627 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (11)..(11): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYXIXLDRXAQXNFVNWXLAQRPSSGAPPPS

SEQ ID NO: 628 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 629 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQRPSSGAPPPS

SEQ ID NO: 630 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (15)..(15): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXLXRXAQXNFVNWXLAQRPSSGAPPPS

SEQ ID NO: 631 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (16)..(16): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXLDXXAQXNFVNWXLAQRPSSGAPPPS

SEQ ID NO: 632 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (18)..(18): Xaa stands for Lys(Eda-PEG(2)-)
  MISC_FEATURE (20)..(20): Xaa stands for Aib
  MISC_FEATURE (26)..(26): Xaa stands for Iva
YXEGTXISDYSIXLDRXXQXNFVNWXLAQRPSSGAPPPS

SEQ ID NO: 633 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (19)..(19): Xaa stands for Lys(Eda-PEG(2)-)
  MISC_FEATURE (20)..(20): Xaa stands for Aib
  MISC_FEATURE (26)..(26): Xaa stands for Iva
YXEGTXISDYSIXLDRXAXXNFVNWXLAQRPSSGAPPPS

SEQ ID NO: 634 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Lys(Eda-PEG(2)-)
  MISC_FEATURE (26)..(26): Xaa stands for Iva

SEQ ID NO: 635 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (21)..(21): Xaa stands for Lys(Eda-PEG(2)-)
  MISC_FEATURE (26)..(26): Xaa stands for Iva
YXEGTXISDYSIXLDRXAQXXFVNWXLAQRPSSGAPPPS

SEQ ID NO: 636 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (22)..(22): Xaa stands for Lys(Eda-PEG(2)-)
  MISC_FEATURE (26)..(26): Xaa stands for Iva
YXEGTXISDYSIXLDRXAQXNXVNWXLAQRPSSGAPPPS

SEQ ID NO: 637 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (23)..(23): Xaa stands for Lys(Eda-PEG(2)-)
  MISC_FEATURE (26)..(26): Xaa stands for Iva
YXEGTXISDYSIXLDRXAQXNFXNWXLAQRPSSGAPPPS

SEQ ID NO: 638 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (24)..(24): Xaa stands for Lys(Eda-PEG(2)-)
  MISC_FEATURE (26)..(26): Xaa stands for Iva
YXEGTXISDYSIXLDRXAQXNFVXWXLAQRPSSGAPPPS

SEQ ID NO: 639 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (25)..(25): Xaa stands for Lys(Eda-PEG(2)-)
  MISC_FEATURE (26)..(26): Xaa stands for Iva
YXEGTXISDYSIXLDRXAQXNFVNXXLAQRPSSGAPPPS

SEQ ID NO: 640 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Lys(Eda-PEG(2)-)

SEQ ID NO: 641 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (27)..(27): Xaa stands for Lys(Eda-PEG(2)-)
YXEGTXISDYSIXLDRXAQXNFVNWXXAQRPSSGAPPPS

SEQ ID NO: 642 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda- - -)
  MISC_FEATURE (20)..(20): Xaa stands for Aib
  MISC_FEATURE (26)..(26): Xaa stands for Iva

SEQ ID NO: 643 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG3-)
  MISC_FEATURE (20)..(20): Xaa stands for Aib
  MISC_FEATURE (26)..(26): Xaa stands for Iva

SEQ ID NO: 644 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)2-)
  MISC_FEATURE (20)..(20): Xaa stands for Aib
  MISC_FEATURE (26)..(26): Xaa stands for Iva

SEQ ID NO: 645 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)3-)
  MISC_FEATURE (20)..(20): Xaa stands for Aib
  MISC_FEATURE (26)..(26): Xaa stands for Iva

SEQ ID NO: 646 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)4-)
  MISC_FEATURE (20)..(20): Xaa stands for Aib
  MISC_FEATURE (26)..(26): Xaa stands for Iva

SEQ ID NO: 647 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)5-)
  MISC_FEATURE (20)..(20): Xaa stands for Aib
  MISC_FEATURE (26)..(26): Xaa stands for Iva

SEQ ID NO: 648 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-G-)
  MISC_FEATURE (20)..(20): Xaa stands for Aib
  MISC_FEATURE (26)..(26): Xaa stands for Iva

SEQ ID NO: 649 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GG-)
  MISC_FEATURE (20)..(20): Xaa stands for Aib
  MISC_FEATURE (26)..(26): Xaa stands for Iva

SEQ ID NO: 650 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGG-)
  MISC_FEATURE (20)..(20): Xaa stands for Aib
  MISC_FEATURE (26)..(26): Xaa stands for Iva

SEQ ID NO: 651 - protein, 39 aa, Artificial Sequence; identical to SEQ ID NO: 563
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 652 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-Glu-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 653 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 654 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(gamma-E)2-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 655 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(gamma-Glu)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 656 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(gamma-Glu)3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 657 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-GGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 658 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GABA-GGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 659 - protein, 39 aa, Artificial Sequence; identical to SEQ ID NO: 566
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GABA-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 660 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for Lys(Eda-PEG3-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 661 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for Lys(Eda-PEG3-PEG3-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 662 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for Lys(Eda-gamma-E-PEG3-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 663 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for Lys(Eda-gamma-E-(PEG3)2-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 664 - protein, 39 aa, Artificial Sequence; identical to SEQ ID NO: 505
  Synthetic Peptide
  MISC_FEATURE (2)..(2): Xaa stands for Aib
  MISC_FEATURE (12)..(12): Xaa stands for Lys(Eda-GGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 665 - protein, 39 aa, Artificial Sequence; identical to SEQ ID NO: 505
  Synthetic peptide
  MISC_FEATURE (2)..(2): Xaa stands for Aib
  MISC_FEATURE (12)..(12): Xaa stands for Lys(Eda-gamma-Glu-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 666 - protein, 39 aa, Artificial Sequence; identical to SEQ ID NO: 505
  Synthetic peptide
  MISC_FEATURE (2)..(2): Xaa stands for Aib
  MISC_FEATURE (12)..(12): Xaa stands for Lys(Eda-gamma-E-GGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 667 - protein, 39 aa, Artificial Sequence; identical to SEQ ID NO: 505
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 668 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 669 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 670 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 671 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-Tra-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 672 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-Lys-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 673 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-NpipAc-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 674 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-AMBZ-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 675 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-Tra-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 676 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-AMBZ-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 677 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 678 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 679 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 680 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Oda-GGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 681 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Oda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 682 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Oda-gamma-E-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 683 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Oda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 684 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 685 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Oda-GGGG-)
  MISC_FEATURE (20)..(20): Xaa stands for Aib
  MISC_FEATURE (26)..(26): Xaa stands for Iva

SEQ ID NO: 686 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Oda-GGGGG-)
  MISC_FEATURE (20)..(20): Xaa stands for Aib
  MISC_FEATURE (26)..(26): Xaa stands for Iva

SEQ ID NO: 687 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Oda-gamma-E-(PEG3)2-)
  MISC_FEATURE (20)..(20): Xaa stands for Aib
  MISC_FEATURE (26)..(26): Xaa stands for Iva

SEQ ID NO: 688 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Oda-PEG(2)-)
  MISC_FEATURE (20)..(20): Xaa stands for Aib
  MISC_FEATURE (26)..(26): Xaa stands for Iva

SEQ ID NO: 689 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGGG-)
  MISC_FEATURE (20)..(20): Xaa stands for Aib
  MISC_FEATURE (26)..(26): Xaa stands for Iva

SEQ ID NO: 690 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-Tra-GGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 691 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-G9-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Aib

SEQ ID NO: 692 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 693 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-epsilon-Lys-GGG-)
  MISC_FEATURE (13)..(13): Xaa stands for Aib
  MISC_FEATURE (17)..(17): Xaa stands for Aib
  misc_feature (20)..(20): Xaa can be any naturally occurring amino acid
  MISC_FEATURE (26)..(26): Xaa stands for Iva

SEQ ID NO: 694 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-gamma-E-GGG-)
  MISC_FEATURE (20)..(20): Xaa stands for Aib
  MISC_FEATURE (26)..(26): Xaa stands for Iva

SEQ ID NO: 695 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GABA-GGG-)
  MISC_FEATURE (20)..(20): Xaa stands for Aib
  MISC_FEATURE (26)..(26): Xaa stands for Iva

SEQ ID NO: 696 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-epsilon-Lys-GGG-)
  MISC_FEATURE (20)..(20): Xaa stands for Aib
  MISC_FEATURE (26)..(26): Xaa stands for Iva

SEQ ID NO: 697 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-Tra-GGG-)
  MISC_FEATURE (20)..(20): Xaa stands for Aib
  MISC_FEATURE (26)..(26): Xaa stands for Iva

SEQ ID NO: 698 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Dda-GGGGG-)
  MISC_FEATURE (20)..(20): Xaa stands for Aib
  MISC_FEATURE (26)..(26): Xaa stands for Iva

SEQ ID NO: 699 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-G9-)
  MISC_FEATURE (20)..(20): Xaa stands for Aib
  MISC_FEATURE (26)..(26): Xaa stands for Iva

SEQ ID NO: 700 - protein, 30 aa, Artificial Sequence; identical to SEQ ID NO: 599
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 701 - protein, 30 aa, Artificial Sequence; identical to SEQ ID NO: 599
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 702 - protein, 30 aa, Artificial Sequence; identical to SEQ ID NO: 599
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 703 - protein, 30 aa, Artificial Sequence; identical to SEQ ID NO: 599
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 704 - protein, 30 aa, Artificial Sequence; identical to SEQ ID NO: 599
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 705 - protein, 30 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQR

SEQ ID NO: 706 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 707 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 708 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-(PEG3)2-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 709 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-gamma-E-(PEG3)2-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 710 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-(PEG3)3-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 711 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGG-)
  MISC_FEATURE (20)..(20): Xaa stands for Aib
  MISC_FEATURE (26)..(26): Xaa stands for Iva

SEQ ID NO: 712 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 713 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGGG-)
  MISC_FEATURE (20)..(20): Xaa stands for Aib
  MISC_FEATURE (26)..(26): Xaa stands for Iva

SEQ ID NO: 714 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)2-)
  MISC_FEATURE (20)..(20): Xaa stands for Aib
  MISC_FEATURE (26)..(26): Xaa stands for Iva

SEQ ID NO: 715 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-gamma-E-(PEG3)2-) .
  MISC_FEATURE (20)..(20): Xaa stands for Aib
  MISC_FEATURE (26)..(26): Xaa stands for Iva

SEQ ID NO: 716 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)3-)
  MISC_FEATURE (20)..(20): Xaa stands for Aib
  MISC_FEATURE (26)..(26): Xaa stands for Iva

SEQ ID NO: 717 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 718 - protein, 39 aa, Artificial Sequence
  Synthetic peptide
  MISC_FEATURE (2)..(2): Xaa stands for Aib
  MISC_FEATURE (12)..(12): Xaa stands for Lys(Eda-PEG(2)-)
  MISC_FEATURE (26)..(26): Xaa stands for Iva
YXEGTFISDYSXALDRIAQQNFVNWXLAQRPSSGAPPPS

SEQ ID NO: 719 - protein, 39 aa, Artificial Sequence; identical to SEQ ID NO: 718
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (26)..(26): Xaa stands for Iva

SEQ ID NO: 720 - protein, 39 aa, Artificial Sequence
  Synthetic peptide
  MISC_FEATURE (2)..(2): Xaa stands for Aib
  MISC_FEATURE (14)..(14): Xaa stands for Lys(Eda-PEG(2)-)
  MISC_FEATURE (26)..(26): Xaa stands for Iva
YXEGTFISDYSIAXDRIAQQNFVNWXLAQRPSSGAPPPS

SEQ ID NO: 721 - protein, 39 aa, Artificial Sequence; identical to SEQ ID NO: 720
  Synthetic peptide
  MISC_FEATURE (2)..(2): Xaa stands for Aib
  MISC_FEATURE (14)..(14): Xaa stands for Lys(Eda-GGGGG-)
  MISC_FEATURE (26)..(26): Xaa stands for Iva

SEQ ID NO: 722 - protein, 39 aa, Artificial Sequence
  Synthetic peptide
  MISC_FEATURE (2)..(2): Xaa stands for Aib
  MISC_FEATURE (17)..(17): Xaa stands for Lys(Eda-PEG(2)-)
  MISC_FEATURE (26)..(26): Xaa stands for Iva
YXEGTFISDYSIALDRXAQQNFVNWXLAQRPSSGAPPPS

SEQ ID NO: 723 - protein, 39 aa, Artificial Sequence; identical to SEQ ID NO: 722
  Synthetic peptide
  MISC_FEATURE (2)..(2): Xaa stands for Aib
  MISC_FEATURE (17)..(17): Xaa stands for Lys(Eda-GGGGG-)
  MISC_FEATURE (26)..(26): Xaa stands for Iva

SEQ ID NO: 724 - protein, 30 aa, Artificial Sequence
  Synthetic peptide
  MISC_FEATURE (2)..(2): Xaa stands for Aib
  MISC_FEATURE (12)..(12): Xaa stands for Lys(Eda-PEG(2)-)
  MISC_FEATURE (26)..(26): Xaa stands for Iva
YXEGTFISDYSXALDRIAQQNFVNWXLAQR

SEQ ID NO: 725 - protein, 30 aa, Artificial Sequence; identical to SEQ ID NO: 724
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (26)..(26): Xaa stands for Iva

SEQ ID NO: 726 - protein, 30 aa, Artificial Sequence
  Synthetic peptide
  MISC_FEATURE (2)..(2): Xaa stands for Aib
  MISC_FEATURE (14)..(14): Xaa stands for Lys(Eda-PEG(2)-)
  MISC_FEATURE (26)..(26): Xaa stands for Iva
YXEGTFISDYSIAXDRIAQQNFVNWXLAQR

SEQ ID NO: 727 - protein, 30 aa, Artificial Sequence; identical to SEQ ID NO: 726
  Synthetic peptide
  MISC_FEATURE (2)..(2): Xaa stands for Aib
  MISC_FEATURE (14)..(14): Xaa stands for Lys(Eda-GGGGG-)
  MISC_FEATURE (26)..(26): Xaa stands for Iva

SEQ ID NO: 728 - protein, 30 aa, Artificial Sequence
  Synthetic peptide
  MISC_FEATURE (2)..(2): Xaa stands for Aib
  MISC_FEATURE (17)..(17): Xaa stands for Lys(Eda-PEG(2)-)
  MISC_FEATURE (26)..(26): Xaa stands for Iva
YXEGTFISDYSIALDRXAQQNFVNWXLAQR

SEQ ID NO: 729 - protein, 30 aa, Artificial Sequence; identical to SEQ ID NO: 728
  Synthetic peptide
  MISC_FEATURE (2)..(2): Xaa stands for Aib
  MISC_FEATURE (17)..(17): Xaa stands for Lys(Eda-GGGGG-)
  MISC_FEATURE (26)..(26): Xaa stands for Iva

SEQ ID NO: 730 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 731 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 732 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 733 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva

SEQ ID NO: 734 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 735 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 736 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 737 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva

SEQ ID NO: 738 - protein, 39 aa, Artificial Sequence; identical to SEQ ID NO: 718
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (26)..(26): Xaa stands for Iva

SEQ ID NO: 739 - protein, 39 aa, Artificial Sequence; identical to SEQ ID NO: 718
  Synthetic peptide
  MISC_FEATURE (2)..(2): Xaa stands for Aib
  MISC_FEATURE (12)..(12): Xaa stands for Lys(Eda-PEG(2)-)
  MISC_FEATURE (26)..(26): Xaa stands for Iva

SEQ ID NO: 740 - protein, 39 aa, Artificial Sequence; identical to SEQ ID NO: 722
  Synthetic peptide
  MISC_FEATURE (2)..(2): Xaa stands for Aib
  MISC_FEATURE (17)..(17): Xaa stands for Lys(Eda-GGGGG-)
  MISC_FEATURE (26)..(26): Xaa stands for Iva

SEQ ID NO: 741 - protein, 39 aa, Artificial Sequence; identical to SEQ ID NO: 722
  Synthetic peptide
  MISC_FEATURE (2)..(2): Xaa stands for Aib
  MISC_FEATURE (17)..(17): Xaa stands for Lys(Eda-PEG(2)-)
  MISC_FEATURE (26)..(26): Xaa stands for Iva

SEQ ID NO: 742 - protein, 39 aa, Artificial Sequence; identical to SEQ ID NO: 718
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (26)..(26): Xaa stands for Iva

SEQ ID NO: 743 - protein, 39 aa, Artificial Sequence; identical to SEQ ID NO: 718
  Synthetic peptide
  MISC_FEATURE (2)..(2): Xaa stands for Aib
  MISC_FEATURE (12)..(12): Xaa stands for Lys(Eda-PEG(2)-)
  MISC_FEATURE (26)..(26): Xaa stands for Iva

SEQ ID NO: 744 - protein, 39 aa, Artificial Sequence; identical to SEQ ID NO: 722
  Synthetic peptide
  MISC_FEATURE (2)..(2): Xaa stands for Aib
  MISC_FEATURE (17)..(17): Xaa stands for Lys(Eda-GGGGG-)
  MISC_FEATURE (26)..(26): Xaa stands for Iva

SEQ ID NO: 745 - protein, 39 aa, Artificial Sequence; identical to SEQ ID NO: 722
  Synthetic peptide
  MISC_FEATURE (2)..(2): Xaa stands for Aib
  MISC_FEATURE (17)..(17): Xaa stands for Lys(Eda-PEG(2)-)
  MISC_FEATURE (26)..(26): Xaa stands for Iva

SEQ ID NO: 746 - protein, 39 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 747 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 748 - protein, 30 aa, Artificial Sequence; identical to SEQ ID NO: 599
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 749 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva

SEQ ID NO: 750 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 751 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 752 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 753 - protein, 29 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQ

SEQ ID NO: 754 - protein, 29 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQ

SEQ ID NO: 755 - protein, 29 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQ

SEQ ID NO: 756 - protein, 29 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQ

SEQ ID NO: 757 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 758 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Dda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 759 - protein, 30 aa, Artificial Sequence; identical to SEQ ID NO: 599
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 760 - protein, 30 aa, Artificial Sequence; identical to SEQ ID NO: 599
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 761 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 762 - protein, 30 aa, Artificial Sequence; identical to SEQ ID NO: 705
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 763 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 764 - protein, 30 aa, Artificial Sequence; identical to SEQ ID NO: 602
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva

SEQ ID NO: 765 - protein, 30 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (30)..(30): Xaa stands for Lys(Eda-GGGGG-)
YXEGTXISDYSIXLDRXAQXNFVNWXLAQX

SEQ ID NO: 766 - protein, 30 aa, Artificial Sequence; identical to SEQ ID NO: 765
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (30)..(30): Xaa stands for Lys(Eda-PEG(2)-)

SEQ ID NO: 767 - protein, 30 aa, Artificial Sequence; identical to SEQ ID NO: 765
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (30)..(30): Xaa stands for Lys(Eda-GGGGG-)

SEQ ID NO: 768 - protein, 30 aa, Artificial Sequence; identical to SEQ ID NO: 765
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (30)..(30): Xaa stands for Lys(Eda-PEG(2)-)

SEQ ID NO: 769 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 770 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 771 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGGG-)
  MISC_FEATURE (20)..(20): Xaa stands for Aib
  MISC_FEATURE (26)..(26): Xaa stands for Iva

SEQ ID NO: 772 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 773 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 774 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 775 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 776 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 777 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Dda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 778 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 779 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Dda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 780 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 781 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Dda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 782 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Heda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 783 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Teda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 784 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Doda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 785 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Trda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 786 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Trda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 787 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Trda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 788 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Teda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 789 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Teda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 790 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Peda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 791 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Peda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 792 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Peda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 793 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Heda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 794 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Heda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 795 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 796 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 797 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Doda-GGGGG-) .
  MISC_FEATURE (20)..(20): Xaa stands for Aib
  MISC_FEATURE (26)..(26): Xaa stands for Iva

SEQ ID NO: 798 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Teda-GGGGG-)
  MISC_FEATURE (20)..(20): Xaa stands for Aib
  MISC_FEATURE (26)..(26): Xaa stands for Iva

SEQ ID NO: 799 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Heda-GGGGG-)
  MISC_FEATURE (20)..(20): Xaa stands for Aib
  MISC_FEATURE (26)..(26): Xaa stands for Iva

SEQ ID NO: 800 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Hepda-GGGGG-)
  MISC_FEATURE (20)..(20): Xaa stands for Aib
  MISC_FEATURE (26)..(26): Xaa stands for Iva

SEQ ID NO: 801 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hepda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 802 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hepda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 803 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hepda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 804 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hda-G9-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 805 - protein, 22 aa, Artificial Sequence
  Synthetic peptide
  MISC_FEATURE (3)..(3): Xaa stands for Aib
  MISC_FEATURE (9)..(9): Xaa stands for Iva
AQXNFVNWXLAQRPSSGAPPPS

SEQ ID NO: 806 - protein, 30 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXKDRXAQXNFVNWXLAQR

SEQ ID NO: 807 - protein, 39 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXKDRXAQXNFVNWXLAQRPSSGAPPPS

SEQ ID NO: 808 - protein, 40 aa, Artificial Sequence
  Synthetic peptide
  MISC_FEATURE (2)..(2): Xaa stands for Aib
  MISC_FEATURE (14)..(14): Xaa stands for K(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIAXDRXHQXNFVNWXLAQRPSSGAPPPSR

SEQ ID NO: 809 - protein, 40 aa, Artificial Sequence; identical to SEQ ID NO: 808
  Synthetic peptide
  MISC_FEATURE (2)..(2): Xaa stands for Aib
  MISC_FEATURE (14)..(14): Xaa stands for K(Teda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 810 - protein, 40 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQRPSSGAPPPSR

SEQ ID NO: 811 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Teda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 812 - protein, 39 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXHQXNFVNWXLAQRPSSGAPPPS

SEQ ID NO: 813 - protein, 39 aa, Artificial Sequence; identical to SEQ ID NO: 812
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Teda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 814 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Heda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 815 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Heda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 816 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 817 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 818 - protein, 40 aa, Artificial Sequence; identical to SEQ ID NO: 808
  Synthetic peptide
  MISC_FEATURE (2)..(2): Xaa stands for Aib
  MISC_FEATURE (14)..(14): Xaa stands for K(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 819 - protein, 40 aa, Artificial Sequence; identical to SEQ ID NO: 808
  Synthetic peptide
  MISC_FEATURE (2)..(2): Xaa stands for Aib
  MISC_FEATURE (14)..(14): Xaa stands for K(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 820 - protein, 39 aa, Artificial Sequence; identical to SEQ ID NO: 812
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 821 - protein, 39 aa, Artificial Sequence; identical to SEQ ID NO: 812
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 822 - protein, 40 aa, Artificial Sequence; identical to SEQ ID NO: 447
  Synthetic peptide
  MISC_FEATURE (2)..(2): Xaa stands for Aib
  MISC_FEATURE (17)..(17): Xaa stands for K(Oda-GGGGG-)
  MISC_FEATURE (20)..(20): Xaa stands for Aib
  MISC_FEATURE (26)..(26): Xaa stands for Iva

SEQ ID NO: 823 - protein, 40 aa, Artificial Sequence; identical to SEQ ID NO: 447
  Synthetic peptide
  MISC_FEATURE (2)..(2): Xaa stands for Aib
  MISC_FEATURE (17)..(17): Xaa stands for K(Oda-GGGGGG-)
  MISC_FEATURE (20)..(20): Xaa stands for Aib
  MISC_FEATURE (26)..(26): Xaa stands for Iva

SEQ ID NO: 824 - protein, 40 aa, Artificial Sequence; identical to SEQ ID NO: 447
  Synthetic peptide
  MISC_FEATURE (2)..(2): Xaa stands for Aib
  MISC_FEATURE (17)..(17): Xaa stands for K(Eda-GGGGG-)
  MISC_FEATURE (20)..(20): Xaa stands for Aib
  MISC_FEATURE (26)..(26): Xaa stands for Iva

SEQ ID NO: 825 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGG-)
  MISC_FEATURE (20)..(20): Xaa stands for Aib
  MISC_FEATURE (26)..(26): Xaa stands for Iva

SEQ ID NO: 826 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGGG-)
  MISC_FEATURE (20)..(20): Xaa stands for Aib
  MISC_FEATURE (26)..(26): Xaa stands for Iva

SEQ ID NO: 827 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Eda-GGGGG-)
  MISC_FEATURE (20)..(20): Xaa stands for Aib
  MISC_FEATURE (26)..(26): Xaa stands for Iva

SEQ ID NO: 828 - protein, 39 aa, Artificial Sequence; identical to SEQ ID NO: 580
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGG-)
  MISC_FEATURE (20)..(20): Xaa stands for Aib
  MISC_FEATURE (26)..(26): Xaa stands for Iva

SEQ ID NO: 829 - protein, 39 aa, Artificial Sequence; identical to SEQ ID NO: 580
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGGG-)
  MISC_FEATURE (20)..(20): Xaa stands for Aib
  MISC_FEATURE (26)..(26): Xaa stands for Iva

SEQ ID NO: 830 - protein, 39 aa, Artificial Sequence; identical to SEQ ID NO: 580
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Eda-GGGGG-)
  MISC_FEATURE (20)..(20): Xaa stands for Aib
  MISC_FEATURE (26)..(26): Xaa stands for Iva

SEQ ID NO: 831 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGGG-)
  MISC_FEATURE (20)..(20): Xaa stands for Aib
  MISC_FEATURE (26)..(26): Xaa stands for Iva

SEQ ID NO: 832 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGGG-)
  MISC_FEATURE (20)..(20): Xaa stands for Aib
  MISC_FEATURE (26)..(26): Xaa stands for Iva

SEQ ID NO: 833 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGGG-)
  MISC_FEATURE (20)..(20): Xaa stands for Aib
  MISC_FEATURE (26)..(26): Xaa stands for Iva

SEQ ID NO: 834 - protein, 40 aa, Artificial Sequence; identical to SEQ ID NO: 447
  Synthetic peptide
  MISC_FEATURE (2)..(2): Xaa stands for Aib
  MISC_FEATURE (17)..(17): Xaa stands for K(Hepda-GGGGG-)
  MISC_FEATURE (20)..(20): Xaa stands for Aib
  MISC_FEATURE (26)..(26): Xaa stands for Iva

SEQ ID NO: 835 - protein, 40 aa, Artificial Sequence; identical to SEQ ID NO: 447
  Synthetic peptide
  MISC_FEATURE (2)..(2): Xaa stands for Aib
  MISC_FEATURE (17)..(17): Xaa stands for K(Heda-GGGGGG-)
  MISC_FEATURE (20)..(20): Xaa stands for Aib
  MISC_FEATURE (26)..(26): Xaa stands for Iva

SEQ ID NO: 836 - protein, 40 aa, Artificial Sequence; identical to SEQ ID NO: 447
  Synthetic peptide
  MISC_FEATURE (2)..(2): Xaa stands for Aib
  MISC_FEATURE (17)..(17): Xaa stands for K(Hepda-GGGGGG-)
  MISC_FEATURE (20)..(20): Xaa stands for Aib
  MISC_FEATURE (26)..(26): Xaa stands for Iva

SEQ ID NO: 837 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGG-)
  MISC_FEATURE (20)..(20): Xaa stands for Aib
  MISC_FEATURE (26)..(26): Xaa stands for Iva

SEQ ID NO: 838 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGGG-)
  MISC_FEATURE (20)..(20): Xaa stands for Aib
  MISC_FEATURE (26)..(26): Xaa stands for Iva

SEQ ID NO: 839 - protein, 39 aa, Artificial Sequence; identical to SEQ ID NO: 580
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGG-)
  MISC_FEATURE (20)..(20): Xaa stands for Aib
  MISC_FEATURE (26)..(26): Xaa stands for Iva

SEQ ID NO: 840 - protein, 39 aa, Artificial Sequence; identical to SEQ ID NO: 580
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGGG-)
  MISC_FEATURE (20)..(20): Xaa stands for Aib
  MISC_FEATURE (26)..(26): Xaa stands for Iva

SEQ ID NO: 841 - protein, 39 aa, Artificial Sequence; identical to SEQ ID NO: 580
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGGG-)
  MISC_FEATURE (20)..(20): Xaa stands for Aib
  MISC_FEATURE (26)..(26): Xaa stands for Iva

SEQ ID NO: 842 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Hepda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 843 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Hepda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 844 - protein, 39 aa, Artificial Sequence; identical to SEQ ID NO: 812
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Heda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 845 - protein, 39 aa, Artificial Sequence; identical to SEQ ID NO: 812
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Hepda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 846 - protein, 39 aa, Artificial Sequence; identical to SEQ ID NO: 812
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Heda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 847 - protein, 39 aa, Artificial Sequence; identical to SEQ ID NO: 812
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Hepda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 848 - protein, 40 aa, Artificial Sequence; identical to SEQ ID NO: 808
  Synthetic peptide
  MISC_FEATURE (2)..(2): Xaa stands for Aib
  MISC_FEATURE (14)..(14): Xaa stands for K(Heda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 849 - protein, 40 aa, Artificial Sequence; identical to SEQ ID NO: 808
  Synthetic peptide
  MISC_FEATURE (2)..(2): Xaa stands for Aib
  MISC_FEATURE (14)..(14): Xaa stands for K(Hepda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 850 - protein, 40 aa, Artificial Sequence; identical to SEQ ID NO: 808
  Synthetic peptide
  MISC_FEATURE (2)..(2): Xaa stands for Aib
  MISC_FEATURE (14)..(14): Xaa stands for K(Heda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 851 - protein, 40 aa, Artificial Sequence; identical to SEQ ID NO: 808
  Synthetic peptide
  MISC_FEATURE (2)..(2): Xaa stands for Aib
  MISC_FEATURE (14)..(14): Xaa stands for K(Hepda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 852 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGG-)
  MISC_FEATURE (20)..(20): Xaa stands for Aib
  MISC_FEATURE (26)..(26): Xaa stands for Iva

SEQ ID NO: 853 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGGG-)
  MISC_FEATURE (20)..(20): Xaa stands for Aib
  MISC_FEATURE (26)..(26): Xaa stands for Iva

SEQ ID NO: 854 - protein, 39 aa, Artificial Sequence; identical to SEQ ID NO: 580
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGG-)
  MISC_FEATURE (20)..(20): Xaa stands for Aib
  MISC_FEATURE (26)..(26): Xaa stands for Iva

SEQ ID NO: 855 - protein, 40 aa, Artificial Sequence; identical to SEQ ID NO: 447
  Synthetic peptide
  MISC_FEATURE (2)..(2): Xaa stands for Aib
  MISC_FEATURE (17)..(17): Xaa stands for K(Heda-GGGGG-)
  MISC_FEATURE (20)..(20): Xaa stands for Aib
  MISC_FEATURE (26)..(26): Xaa stands for Iva

SEQ ID NO: 856 - protein, 39 aa, Artificial Sequence; identical to SEQ ID NO: 629
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 857 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 858 - protein, 39 aa, Artificial Sequence; identical to SEQ ID NO: 812
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 859 - protein, 40 aa, Artificial Sequence; identical to SEQ ID NO: 808
  Synthetic peptide
  MISC_FEATURE (2)..(2): Xaa stands for Aib
  MISC_FEATURE (14)..(14): Xaa stands for K(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 860 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Heda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 861 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGGG-Heda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 862 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Hepda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 863 - protein, 40 aa, Artificial Sequence; identical to SEQ ID NO: 810
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Oda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 864 - protein, 40 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Heda)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXHQXNFVNWXLAQRPSSGAPPPSR

SEQ ID NO: 865 - protein, 40 aa, Artificial Sequence; identical to SEQ ID NO: 864
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGGG-Heda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 866 - protein, 40 aa, Artificial Sequence; identical to SEQ ID NO: 864
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Hepda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 867 - protein, 40 aa, Artificial Sequence; identical to SEQ ID NO: 864
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Oda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 868 - protein, 40 aa, Artificial Sequence; identical to SEQ ID NO: 864
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Eda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 869 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Heda)
  MISC_FEATURE (20)..(20): Xaa stands for Aib
  MISC_FEATURE (26)..(26): Xaa stands for Iva

SEQ ID NO: 870 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Hepda)
  MISC_FEATURE (20)..(20): Xaa stands for Aib
  MISC_FEATURE (26)..(26): Xaa stands for Iva

SEQ ID NO: 871 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Eda)
  MISC_FEATURE (20)..(20): Xaa stands for Aib
  MISC_FEATURE (26)..(26): Xaa stands for Iva

SEQ ID NO: 872 - protein, 39 aa, Artificial Sequence; identical to SEQ ID NO: 563
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Eda)
  MISC_FEATURE (20)..(20): Xaa stands for Aib
  MISC_FEATURE (26)..(26): Xaa stands for Iva

SEQ ID NO: 873 - protein, 39 aa, Artificial Sequence; identical to SEQ ID NO: 580
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Heda)
  MISC_FEATURE (20)..(20): Xaa stands for Aib
  MISC_FEATURE (26)..(26): Xaa stands for Iva

SEQ ID NO: 874 - protein, 39 aa, Artificial Sequence; identical to SEQ ID NO: 580
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Eda)
  MISC_FEATURE (20)..(20): Xaa stands for Aib
  MISC_FEATURE (26)..(26): Xaa stands for Iva

SEQ ID NO: 875 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Heda)
  MISC_FEATURE (20)..(20): Xaa stands for Aib
  MISC_FEATURE (26)..(26): Xaa stands for Iva

SEQ ID NO: 876 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Heda)
  MISC_FEATURE (20)..(20): Xaa stands for Aib
  MISC_FEATURE (26)..(26): Xaa stands for Iva

SEQ ID NO: 877 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Hepda)
  MISC_FEATURE (20)..(20): Xaa stands for Aib
  MISC_FEATURE (26)..(26): Xaa stands for Iva

SEQ ID NO: 878 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Hepda)
  MISC_FEATURE (20)..(20): Xaa stands for Aib
  MISC_FEATURE (26)..(26): Xaa stands for Iva

SEQ ID NO: 879 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Oda)
  MISC_FEATURE (20)..(20): Xaa stands for Aib
  MISC_FEATURE (26)..(26): Xaa stands for Iva

SEQ ID NO: 880 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Oda)
  MISC_FEATURE (20)..(20): Xaa stands for Aib
  MISC_FEATURE (26)..(26): Xaa stands for Iva

SEQ ID NO: 881 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Eda)
  MISC_FEATURE (20)..(20): Xaa stands for Aib
  MISC_FEATURE (26)..(26): Xaa stands for Iva

SEQ ID NO: 882 - protein, 40 aa, Artificial Sequence; identical to SEQ ID NO: 417
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Eda)
  MISC_FEATURE (20)..(20): Xaa stands for Aib
  MISC_FEATURE (26)..(26): Xaa stands for Iva

SEQ ID NO: 883 - protein, 40 aa, Artificial Sequence; identical to SEQ ID NO: 449
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Heda)
  MISC_FEATURE (20)..(20): Xaa stands for Aib
  MISC_FEATURE (26)..(26): Xaa stands for Iva

SEQ ID NO: 884 - protein, 40 aa, Artificial Sequence; identical to SEQ ID NO: 449
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Heda)
  MISC_FEATURE (20)..(20): Xaa stands for Aib
  MISC_FEATURE (26)..(26): Xaa stands for Iva

SEQ ID NO: 885 - protein, 40 aa, Artificial Sequence; identical to SEQ ID NO: 449
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Hepda)
  MISC_FEATURE (20)..(20): Xaa stands for Aib
  MISC_FEATURE (26)..(26): Xaa stands for Iva

SEQ ID NO: 886 - protein, 40 aa, Artificial Sequence; identical to SEQ ID NO: 449
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Hepda)
  MISC_FEATURE (20)..(20): Xaa stands for Aib
  MISC_FEATURE (26)..(26): Xaa stands for Iva

SEQ ID NO: 887 - protein, 40 aa, Artificial Sequence; identical to SEQ ID NO: 449
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Oda)
  MISC_FEATURE (20)..(20): Xaa stands for Aib
  MISC_FEATURE (26)..(26): Xaa stands for Iva

SEQ ID NO: 888 - protein, 40 aa, Artificial Sequence; identical to SEQ ID NO: 449
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Eda)
  MISC_FEATURE (20)..(20): Xaa stands for Aib
  MISC_FEATURE (26)..(26): Xaa stands for Iva

SEQ ID NO: 889 - protein, 40 aa, Artificial Sequence; identical to SEQ ID NO: 449
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Eda)
  MISC_FEATURE (20)..(20): Xaa stands for Aib
  MISC_FEATURE (26)..(26): Xaa stands for Iva

SEQ ID NO: 890 - protein, 40 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Leu. Provided that any one amino acid selected from A14 and A17 represent Lys(R).
  MISC_FEATURE (17)..(17): Xaa stands for Aib
  MISC_FEATURE (18)..(18): Xaa stands for Ala or His
  MISC_FEATURE (20)..(20): Xaa stands for Aib
  MISC_FEATURE (26)..(26): Xaa stands for Iva
  MISC_FEATURE (40)..(40): Xaa stands for Arg or a deletion
YXEGTXISDYSIXXDRXXQXNFVNWXLAQRPSSGAPPPSX

SEQ ID NO: 891 - protein, 40 aa, Artificial Sequence
  Synthetic peptide
  MISC_FEATURE (2)..(2): Xaa stands for Aib
  MISC_FEATURE (6)..(6): Xaa stands for Iva, Phe, or Val
  MISC_FEATURE (7)..(7): Xaa stands for Ile or Val
  MISC_FEATURE (9)..(9): Xaa stands for Asp or Leu
  MISC_FEATURE (13)..(13): Xaa stands for Aib or Ala
  MISC_FEATURE (16)..(16): Xaa stands for Arg or Lys
  MISC_FEATURE (17)..(17): Xaa stands for Aib, Gln, or Ile
  MISC_FEATURE (18)..(18): Xaa stands for Ala or His
  MISC_FEATURE (20)..(20): Xaa stands for Aib, or Gln
  MISC_FEATURE (21)..(21): Xaa stands for Asn, Glu, or Asp
  MISC_FEATURE (24)..(24): Xaa stands for Arg, Asn, or Lys
  MISC_FEATURE (26)..(26): Xaa stands for Iva or Leu
  MISC_FEATURE (28)..(28): Xaa stands for Ala, Arg, or Lys
  MISC_FEATURE (29)..(29): Xaa stands for Gln or Gly
  MISC_FEATURE (30)..(30): Xaa stands for Arg, or Gly
  MISC_FEATURE (40)..(40): Xaa stands for Arg, Lys, or a deletion
YXEGTXXSXYSIXLDXXXQXXFVXWXLXXXPSSGAPPPSX

SEQ ID NO: 892 - protein, 40 aa, Artificial Sequence; identical to SEQ ID NO: 890
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(R), wherein R represents X-L-,  -L- represents -GGGGG- or -GGGGGG- and X represents Heda, Hepda, Oda or Eda
  MISC_FEATURE (17)..(17): Xaa stands for Aib
  MISC_FEATURE (18)..(18): Xaa stands for Ala or His
  MISC_FEATURE (20)..(20): Xaa stands for Aib
  MISC_FEATURE (26)..(26): Xaa stands for Iva
  MISC_FEATURE (40)..(40): Xaa stands for Arg or a deletion

SEQ ID NO: 893 - protein, 40 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(R), wherein R represents -L-X, -L- represents -GGGGG- or -GGGGGG- and X represents Heda, Hepda, Oda or Eda.
  MISC_FEATURE (17)..(17): Xaa stands for Lys(R), wherein R represents X-L-, -L- represents -GGGGG- or -GGGGGG- and X represents Heda, Hepda, Oda or Eda.
  MISC_FEATURE (18)..(18): Xaa stands for Ala or His
  MISC_FEATURE (20)..(20): Xaa stands for Aib
  MISC_FEATURE (26)..(26): Xaa stands for Iva
  MISC_FEATURE (40)..(40): Xaa stands for Arg or a deletion
YXEGTXISDYSIXLDRXXQXNFVNWXLAQRPSSGAPPPSX

The invention claimed is:

1. A GIP receptor agonist peptide represented by formula (I):  $P^1$-A1-A2-A3-A4-A5-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-$P^2$ (SEQ ID NO: 4), or a salt thereof;
wherein
$P^1$ represents a group represented by formula
  —$R^{41}$,
  —CO—$R^{41}$,
  —CO—$OR^{41}$,
  —CO—$COR^{41}$,
  —SO—$R^{41}$,
  —$SO_2$—$R^{41}$,
  —$SO_2$—$OR^{41}$
  —CO—$NR^{42}R^{43}$,
  —$SO_2$—$NR^{42}R^{43}$,
  —C(=$NR^{41}$)—$NR^{42}R^{43}$, or
  is absent,
  wherein $R^{41}$, $R^{42}$, and $R^{43}$ each independently represent a hydrogen atom, an optionally substituted hydrocarbon group, or an optionally substituted heterocyclic group;
$P^2$ represents —$NH_2$ or —OH;
A1 represents Tyr, 3,5-Dix Tyr, D-Tyr, 3,5 di-Br-Tyr, Phe, αMethyl-Phe, mono-halo-Phe, bis-halo-Phe, -Tyr, -D-Phe, -D-Tyr, des-amino-Phe, or des-amino-Tyr;
A2 represents Aib;
A3 represents Glu or Pro;
A4 represents Gly, or Ser;
A5 represents Thr, D-Iva, Glu, Iva, or Ser;
A6 represents Phe, or Val;

A7 represents Ile, or Val;
A8 represents Ser;
A9 represents Asp, Leu, or Phe;
A10 represents Tyr;
A11 represents Aib or Ser;
A12 represents Ile, Ala, or Aib;
A13 represents Aib, Ala, Gln, Leu, or D-Iva;
A14 represents Leu;
A15 represents Asp, Lys, Ser, or Tyr;
A16 represents Arg, or Lys;
A17 represents Aib, or Gln;
A18 represents Ala or His;
A19 represents Gln or Ser;
A20 represents Aib, Ala or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg or Gly;
A31 represents Pro, Gly ψ, or a deletion;
A32 represents Ser, Gly, ψ, or a deletion;
A33 represents Ser, Gly, ψ, or a deletion;
A34 represents Gly, ψ or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents, Ser, ψ, or a deletion;
A41 represents Gly, ψ, or a deletion;
and wherein any one or two amino acids selected from A31 to A41 represent ψ, wherein ψ is a residue independently selected from Lys, Orn, and Cys and wherein the side chain of said residue is substituted.

2. The GIP receptor agonist peptide according to claim 1, represented by formula (II):

P$^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-P$^2$ (SEQ ID NO: 5) or a salt thereof, wherein:

P$^1$ represents a group represented by formula
—R$^{41}$,
—CO—R$^{41}$,
—CO—OR$^{41}$,
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$
wherein R$^{41}$, R$^{42}$, and R$^{43}$ each independently represent a hydrogen atom, an optionally substituted hydrocarbon group, or an optionally substituted heterocyclic group;
P$^2$ represents —NH$_2$ or —OH;
A2 represents Aib;
A6 represents Phe, or Val;
A7 represents Ile or Val;
A8 represents Ser;
A9 represents Leu, or Phe;
A10 represents Tyr;
A11 represents Aib or Ser;
A12 represents Ile;
A13 represents Aib, Ala, Gln, Leu, or D-Iva;
A14 represents Leu;
A15 represents Asp, Lys, Ser, or Tyr;
A16 represents Lys;
A17 represents Aib or Gln;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, or Gly;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Ser, ψ, or a deletion;
A41 represents Gly, ψ, or a deletion;
and wherein any one or two amino acids selected from A31 to A41 represent ψ, wherein ψ is a residue independently selected from Lys, Orn, and Cys, and wherein the side chain of said residue is substituted.

3. The GIP receptor agonist peptide according to claim 1, represented by formula (III):

P$^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-P$^2$ (SEQ ID NO: 6), or a salt thereof, wherein:

P$^1$ represents a group represented by formula
—R$^{41}$,
—CO—R$^{41}$,
—CO—OR$^{41}$,
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$
wherein R$^{41}$, R$^{42}$, and R$^{43}$ each independently represent a hydrogen atom, an optionally substituted hydrocarbon group, or an optionally substituted heterocyclic group;
P$^2$ represents —NH$_2$ or —OH;
A2 represents Aib;
A6 represents Phe, or Val;
A7 represents Ile or Val;
A8 represents Ser;
A9 represents Leu, or Phe;
A10 represents Tyr;
A11 represents Aib or Ser;
A12 represents Ile;

A13 represents Aib;
A14 represents Leu;
A15 represents Lys, Ser, or Tyr;
A16 represents Lys;
A17 represents Aib or Gln;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Asp or Lys;
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, or Gly;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Ser, ψ, or a deletion;
A41 represents Gly, ψ, or a deletion;
and wherein any one or two amino acids selected from A31 to A41 represent ψ, wherein ψ is a residue independently selected from Lys, Orn, and Cys, and wherein the side chain of said residue is substituted.

4. The GIP receptor agonist peptide according to claim 1, represented by formula (IV):
$P^1$-A1-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-A41-$P^2$ (SEQ ID NO: 7) or a salt thereof, wherein:
$P^1$ represents a group represented by formula
—$R^{41}$,
—CO—$R^{41}$,
—CO—$OR^{41}$,
—CO—$COR^{41}$,
—SO—$R^{41}$,
—$SO_2$—$R^{41}$,
—$SO_2$—$OR^{41}$,
—CO—$NR^{42}R^{43}$,
—$SO_2$—$NR^{42}R^{43}$, or
—C(=$NR^{41}$)—$NR^{42}R^{43}$
wherein $R^{41}$, $R^{42}$, and $R^{43}$ each independently represent a hydrogen atom, an optionally substituted hydrocarbon group, or an optionally substituted heterocyclic group;
$P^2$ represents —$NH_2$ or —OH;
A1 represents Tyr;
A2 represents Aib;
A6 represents Phe, or Val;
A7 represents Ile or Val;
A8 represents Ser;
A9 represents Leu, or Phe;
A10 represents Tyr;
A11 represents Aib or Ser;
A12 represents Ile;
A13 represents Aib, Ala, or D-Iva;
A14 represents Leu;
A15 represents Lys, Ser, or Tyr;
A16 represents Lys;
A17 represents Aib or Gln;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Lys;
A29 represents Gln or Gly;
A30 represents Arg;
A31 represents Pro, Gly, ψ, or a deletion;
A32 represents Ser, Gly, ψ, or a deletion;
A33 represents Ser, Gly, ψ, or a deletion;
A34 represents Gly, ψ, or a deletion;
A35 represents Ala, Ser, ψ, or a deletion;
A36 represents Pro, Gly, ψ, or a deletion;
A37 represents Pro, Gly, ψ, or a deletion;
A38 represents Pro, Gly, ψ, or a deletion;
A39 represents Ser, Gly, ψ, or a deletion;
A40 represents Ser, ψ, or a deletion;
A41 represents Gly, ψ, or a deletion;
and wherein any one or two amino acids selected from A31 to A41 represent ψ, wherein ψ is a residue independently selected from Lys, Orn, and Cys, and wherein the side chain of said residue is substituted.

5. The GIP receptor agonist peptide according to claim 1 represented by formula (V): wherein A1-A2-Glu-Gly-Thr-A6-A7-A8-A9-A10-A11-A12-A13-A14-A15-A16-A17-A18-A19-A20-A21-A22-A23-A24-A25-A26-A27-A28-A29 in formula (I) is Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln (SEQ ID NO: 8) or a salt thereof.

6. The GIP receptor agonist peptide according to claim 1 represented by formula (VI):
$P^1$-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-A30-A31-A32-A33-A34-A35-A36-A37-A38-A39-A40-A41-$P^2$ (SEQ ID NO: 9) or a salt thereof,
wherein
$P^1$ represents a group represented by formula
—$R^{41}$,
—CO—$R^{41}$,
—CO—$OR^{41}$,
—CO—$COR^{41}$,
—SO—$R^{41}$,
—$SO_2$—$R^{41}$,
—$SO_2$—$OR^{41}$,
—CO—$NR^{42}R^{43}$,
—$SO_2$—$NR^{42}R^{43}$, or
—C(=$NR^{41}$)—$NR^{42}R^{43}$
wherein $R^{41}$, $R^{42}$, and $R^{43}$ each independently represent a hydrogen atom, an optionally substituted hydrocarbon group, or an optionally substituted heterocyclic group;
$P^2$ represents —$NH_2$ or —OH;
A30 represents Arg;
A31 represents Pro, Gly, or Lys(R);
A32 represents Ser, Gly, or Lys(R);
A33 represents Ser, Gly, or Lys(R);

A34 represents Gly, or Lys(R);
A35 represents Ala, Ser, or Lys(R);
A36 represents Pro, Gly, or Lys(R);
A37 represents Pro, Gly, Lys(R), or a deletion;
A38 represents Pro, Gly, Lys(R), or a deletion;
A39 represents Ser, Gly, Lys(R), or a deletion;
A40 represents Ser, Lys(R), or a deletion;
A41 represents Gly, Lys(R), or a deletion;
and wherein any one or two amino acids selected from A31 to A41 represent Lys(R), and wherein (R) represents a substituent group.

7. The GIP receptor agonist peptide according to claim 1, represented by formula (VII):
P$^1$-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-A30-A31-A32-A33-A34-A35-A36-A37-A38-A39-P$^2$ (SEQ ID NO: 10), or a salt thereof, wherein:
P$^1$ represents a group represented by formula
—R$^{41}$,
—CO—R$^{41}$,
—CO—OR$^{41}$
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$
wherein R$^{41}$, R$^{42}$, and R$^{43}$ each independently represent a hydrogen atom, an optionally substituted hydrocarbon group, or an optionally substituted heterocyclic group;
P$^2$ represents —NH$_2$ or —OH;
A30 represents Arg;
A31 represents Pro or Lys(R);
A32 represents Ser or Lys(R);
A33 represents Ser or Lys(R);
A34 represents Gly or Lys(R);
A35 represents Ala, or Lys(R);
A36 represents Pro or Lys(R);
A37 represents Pro or Lys(R);
A38 represents Pro or Lys(R);
A39 represents Ser or Lys(R);
and wherein any one or two amino acids selected from A31 to A39 represent Lys(R), and (R) represents a substituent group, or a salt thereof.

8. The GIP receptor agonist peptide according to claim 1, represented by formula (VIII):
P$^1$-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-A30-A31-A32-A33-A34-A35-A36-A37-A38-A39-A40-P$^2$ (SEQ ID NO: 11), or a salt thereof, wherein:
P$^1$ represents a group represented by formula
—R$^{41}$,
—CO—R$^{41}$,
—CO—OR$^{41}$,
—CO—COR$^{41}$,
—SO—R$^{41}$,
—SO$_2$—R$^{41}$,
—SO$_2$—OR$^{41}$,
—CO—NR$^{42}$R$^{43}$,
—SO$_2$—NR$^{42}$R$^{43}$, or
—C(=NR$^{41}$)—NR$^{42}$R$^{43}$
wherein R$^{41}$, R$^{42}$, and R$^{43}$ each independently represent a hydrogen atom, an optionally substituted hydrocarbon group, or an optionally substituted heterocyclic group;
P$^2$ represents —NH$_2$, or —OH;
A30 represents Arg;
A31 represents Pro or Lys(R);
A32 represents Ser or Lys(R);
A33 represents Ser or Lys(R);
A34 represents Gly or Lys(R);
A35 represents Ala or Lys(R);
A36 represents Pro or Lys(R);
A37 represents Pro or Lys(R);
A38 represents Pro or Lys(R);
A39 represents Ser or Lys(R);
A40 represents Ser;
and wherein any one or two amino acids selected from A31 to A39 represent Lys(R), and (R) represents a substituent group, or a salt thereof.

9. The GIP receptor agonist peptide according to claim 1, wherein ψ is a residue independently selected from Lys, Orn, and Cys, and wherein the side chain of said residue is substituted with X-L-, wherein L represents a bond or a bivalent substituent group, and X represents an optionally substituted hydrocarbon group, or a salt thereof.

10. The GIP receptor agonist peptide according to claim 1, wherein ψ is a Lys residue having a side chain substituted with X-L-, wherein L represents a bond or a bivalent substituent group, and X represents an optionally substituted hydrocarbon group, or a salt thereof.

11. The GIP receptor agonist peptide according to claim 9, wherein L represents (PEG3)2-, Abu-, GG, GGG, GGGG (SEQ ID NO: 283), GGGGG (SEQ ID NO: 284), GGGGGG (SEQ ID NO: 285), GGGGGGG (SEQ ID NO: 286), GGGGGGGG (SEQ ID NO: 287), gGlu$_{(1-3)}$-, or combinations thereof.

12. The GIP receptor agonist peptide according to claim 9, wherein L represents (PEG3)2-gGlu-, Abu-gGlu-, (Gly)$_5$-gGlu- (SEQ ID NO: 289), (Gly)$_6$-gGlu- (SEQ ID NO: 290), GGGGG- (SEQ ID NO: 284), (PEG3)2-, or (PEG3)2-(Gly)$_{5-6}$- (SEQ ID NOs: 291, 292).

13. The GIP receptor agonist peptide according to claim 9, wherein the bivalent substituent group comprises: an alkylene group, a carbonyl group, an oxycarbonyl group, an imino group, an alkylimino group, a sulfonyl group, an oxy group, a sulfide group, an ester bond, an amide bond, a carbonate bond or combinations thereof.

14. The GIP receptor agonist peptide according to claim 9, wherein X is a C$_6$-C$_{20}$ monacid, a C$_6$-C$_{20}$ diacid or an acetyl group.

15. The GIP receptor agonist peptide according to claim 14, wherein X is (Trda:C13 diacid), (Teda:C14 diacid), (Peda:C15 diacid), (Heda:C16 diacid), (Hepda:C17 diacid), (Oda:C18 diacid), or (Eda:C20 diacid).

16. The GIP receptor agonist peptide according to claim 9, wherein X-L-is-(g-Glu)$_2$-Oda, -(g-Glu)$_2$-Eda, -(g-Glu)$_2$-Heda, -(PEG3)2-gGlu-Eda, -(PEG3)2-gGlu-Heda, -(PEG3)2-gGlu-Oda, -(PEG3)2-gGlu-Ida, -(PEG3)-gGlu-Eda, -(PEG3)-gGlu-Heda, -(PEG3)-gGlu-Oda, -Abu-gGlu-Oda, -(Gly)s-gGlu (SEQ ID NO: 289)-Eda, -(Gly)$_5$-gGlu-Heda (SEQ ID NO: 294), -(Gly)s-gGlu-Oda (SEQ ID NO: 295), -(Gly)$_5$-Heda (SEQ ID NO: 309), -(Gly)$_5$-Oda (SEQ ID NO: 315), -(Gly)5-Eda (SEQ ID NO: 318), -(PEG3)2-Heda, -(PEG3)2-Eda, -(PEG3)2-Oda, or combinations thereof.

17. The GIP receptor agonist peptide according to claim 1, wherein the GIP receptor agonist peptide has a selectivity ratio, expressed as a ratio of (GLP1R $EC_{50}$/GIPR $EC_{50}$) of greater than 10, or greater than 100, or greater than 1,000, or greater than 100,000.

18. A method for preventing or treating emesis in a subject, comprising administering an effective amount of the peptide of claim 1, or a salt thereof to the subject.

19. The method according to claim 18, wherein the emesis is nausea and/or vomiting.

20. The method according to claim 19, where the vomiting or the nausea is caused by one or more conditions or causes selected from the following (1) to (11):
(1) Diseases accompanied by vomiting or nausea;
(2) Vomiting and/or nausea induced by chemotherapeutic drugs;
(3) Vomiting or nausea caused by radiation sickness or radiation therapy used to treat cancers;
(4) Vomiting or nausea caused by a poisonous substance or a toxin;
(5) Vomiting and nausea caused by pregnancy; and
(6) Vomiting and nausea caused by a vestibular disorder;
(7) Opioid withdrawal;
(8) Pregnancy;
(9) A vestibular disorder;
(10) A physical injury causing local, systemic, acute or chronic pain, and
(11) A result of cyclic vomiting syndrome, or nausea or vomiting associated with chemotherapy.

21. The method of claim 18, wherein the subject is a non-type 2 diabetes mellitus subject or a type 2 diabetes mellitus subject.

22. The method according to claim 18, wherein the emesis is delayed emesis or anticipatory emesis.

23. The method according to claim 18, wherein emesis is treated in the subject without inducing anxiety or sedation in the subject, or without inducing suppression of glucagon secretion when plasma glucose levels are above fasting levels, or without substantially activating the GLP-1 receptor, or without concomitant, subsequent, or prior administration of a GLP-1 receptor agonist.

24. The method according to claim 18, wherein emesis is treated in a subject not taking a medicament to control a metabolic syndrome disorder, or is treated in a subject taking a medicament to control a metabolic syndrome disorder, wherein the metabolic syndrome disorder is type 2 diabetes mellitus or obesity.

25. The method according to claim 20, wherein where the chemotherapy or chemotherapeutic agent comprises: (i) alkylating agents or vinca alkaloids; (ii) opioid analgesics; (iii) dopamine receptor DID2 agonists; or (iv) cannabis and cannabinoid products including cannabis hyperemesis syndrome.

26. The method according to claim 18, wherein the GIP receptor agonist peptide is administered subcutaneously, intravenously, intramuscularly, intraperitoneally, orally or via inhalation to the subject before, during, or after the subject develops the disease-state, wherein the effective amount of the GIP receptor agonist peptide administered to the subject is about 0.01 to 0.5 mg/kg/day, 0.1 to 5 mg/kg/day, 5 to 10 mg/kg/day, 10 to 20 mg/kg/day, 20 to 50 mg/kg/day, 10 to 100 mg/kg/day, 10 to 120 mg/kg/day, 50 to 100 mg/kg/day, 100 to 200 mg/kg/day, 200 to 300 mg/kg/day, 300 to 400 mg/kg/day, 400 to 500 mg/kg/day, 500 to 600 mg/kg/day, 600 to 700 mg/kg/day, 700 to 800 mg/kg/day, 800 to 900 mg/kg/day, or 900 to 1000 mg/kg/day.

27. The method according to claim 18, wherein the GIP receptor agonist peptide is administered to the subject 1-3 times per day or 1-7 times per week for 1-5 days, 1-5 weeks, 1-5 months, or 1-5 years.

28. The method according to claim 20, where the vomiting or the nausea is caused by one or more conditions or causes selected from gastroparesis, gastrointestinal hypomotility, peritonitis, abdominal tumor, constipation, gastrointestinal obstruction, chronic intestinal pseudo-obstruction, functional dyspepsia, cyclic vomiting syndrome, chronic unexplained nausea and vomiting, acute pancreatitis, chronic pancreatitis, hepatitis, hyperkalemia, cerebral edema, intracranial lesion, metabolic disorder, gastritis caused by an infection, postoperative disease, myocardial infarction, migraine, intracranial hypertension, intracranial hypotension, altitude sickness, radiation therapy for the chest, radiation therapy for the abdomen, hyperemesis gravidarium, motion sickness and dizziness.

29. The method according to claim 25, where the chemotherapeutic drug includes dactinomycin, doxorubicin, mitomycin-C, bleomycin, epirubicin, actinomycin D, amrubicin, idarubicin, daunorubicin, pirarubicin, cytarabine, methotrexate, 5-fluorouracil, enocitabine, clofarabine, etoposide, vinblastine, vincristine, cisplatin, procarbazine, hydroxyurea, azacytidine, irinotecan, interferon α, interleukin-2, oxaliplatin, carboplatin, nedaplatin, miriplatin; morphine, apomorphine, cyclophosphamide, carmustine, lomustine, chlorambucil, streptozocin, dacarbazine, ifosfamide, temozolomide, busulfan, bendamustine, or melphalan.

* * * * *